United States Patent 10,226,492 (PROBIOTIC AND NEW BIOMARKER) - sequence listing, part 3

SEQ ID NO: 175 - DNA, 2927755 bp, Lactobacillus plantarum (residues 1,463,879-2,927,755 of 2,927,755)
  misc_feature (81804)..(81813): n is a, c, g, or t
  misc_feature (86604)..(86613): n is a, c, g, or t
  misc_feature (88169)..(88178): n is a, c, g, or t
  misc_feature (163816)..(163825): n is a, c, g, or t
  misc_feature (183102)..(183111): n is a, c, g, or t
  misc_feature (199499)..(199508): n is a, c, g, or t
  misc_feature (249705)..(249714): n is a, c, g, or t
  misc_feature (274462)..(274471): n is a, c, g, or t
  misc_feature (275771)..(275780): n is a, c, g, or t
  misc_feature (294692)..(294701): n is a, c, g, or t
  misc_feature (295555)..(295564): n is a, c, g, or t
  misc_feature (327040)..(327049): n is a, c, g, or t
  misc_feature (332210)..(332219): n is a, c, g, or t
  misc_feature (354161)..(354170): n is a, c, g, or t
  misc_feature (356621)..(356630): n is a, c, g, or t
  misc_feature (387908)..(387917): n is a, c, g, or t
  misc_feature (394790)..(394799): n is a, c, g, or t
  misc_feature (429493)..(429502): n is a, c, g, or t
  misc_feature (468182)..(468191): n is a, c, g, or t
  misc_feature (507905)..(507914): n is a, c, g, or t
  misc_feature (514682)..(514691): n is a, c, g, or t
  misc_feature (556854)..(556863): n is a, c, g, or t
  misc_feature (668163)..(668172): n is a, c, g, or t
  misc_feature (742413)..(742422): n is a, c, g, or t
  misc_feature (749912)..(749921): n is a, c, g, or t
  misc_feature (752014)..(752023): n is a, c, g, or t
  misc_feature (769413)..(769422): n is a, c, g, or t
  misc_feature (809663)..(809672): n is a, c, g, or t
  misc_feature (813524)..(813533): n is a, c, g, or t
  misc_feature (889151)..(889160): n is a, c, g, or t
  misc_feature (927365)..(927374): n is a, c, g, or t
  misc_feature (928476)..(928485): n is a, c, g, or t
  misc_feature (967853)..(967862): n is a, c, g, or t
  misc_feature (1009021)..(1009030): n is a, c, g, or t
  misc_feature (1016016)..(1016025): n is a, c, g, or t
  misc_feature (1016968)..(1016977): n is a, c, g, or t
  misc_feature (1029530)..(1029539): n is a, c, g, or t
  misc_feature (1062103)..(1062112): n is a, c, g, or t
  misc_feature (1079287)..(1079296): n is a, c, g, or t
  misc_feature (1086209)..(1086218): n is a, c, g, or t
  misc_feature (1146586)..(1146595): n is a, c, g, or t
  misc_feature (1154707)..(1154716): n is a, c, g, or t
  misc_feature (1185653)..(1185662): n is a, c, g, or t
  misc_feature (1300383)..(1300392): n is a, c, g, or t
  misc_feature (1413091)..(1413100): n is a, c, g, or t
  misc_feature (1450241)..(1450250): n is a, c, g, or t
  misc_feature (1484619)..(1484628): n is a, c, g, or t
  misc_feature (1488523)..(1488532): n is a, c, g, or t
  misc_feature (1503073)..(1503082): n is a, c, g, or t
  misc_feature (1507790)..(1507799): n is a, c, g, or t
  misc_feature (1562182)..(1562191): n is a, c, g, or t
  misc_feature (1608761)..(1608770): n is a, c, g, or t
  misc_feature (1662111)..(1662120): n is a, c, g, or t
  misc_feature (1720792)..(1720801): n is a, c, g, or t
  misc_feature (1784123)..(1784132): n is a, c, g, or t
  misc_feature (1785048)..(1785057): n is a, c, g, or t
  misc_feature (1838993)..(1839002): n is a, c, g, or t
  misc_feature (1860352)..(1860361): n is a, c, g, or t
  misc_feature (1861096)..(1861105): n is a, c, g, or t
  misc_feature (1911743)..(1911753): n is a, c, g, or t
  misc_feature (1928610)..(1928619): n is a, c, g, or t
  misc_feature (1983163)..(1983172): n is a, c, g, or t
  misc_feature (2032263)..(2032272): n is a, c, g, or t
  misc_feature (2083486)..(2083495): n is a, c, g, or t
  misc_feature (2098698)..(2098707): n is a, c, g, or t
  misc_feature (2114670)..(2114679): n is a, c, g, or t
  misc_feature (2135286)..(2135295): n is a, c, g, or t
  misc_feature (2145198)..(2145207): n is a, c, g, or t
  misc_feature (2146976)..(2146985): n is a, c, g, or t
  misc_feature (2150336)..(2150345): n is a, c, g, or t
  misc_feature (2167341)..(2167350): n is a, c, g, or t
  misc_feature (2172649)..(2172658): n is a, c, g, or t
  misc_feature (2323519)..(2323528): n is a, c, g, or t
  misc_feature (2330848)..(2330857): n is a, c, g, or t
  misc_feature (2358289)..(2358298): n is a, c, g, or t
  misc_feature (2374109)..(2374118): n is a, c, g, or t
  misc_feature (2424089)..(2424098): n is a, c, g, or t
  misc_feature (2438700)..(2438709): n is a, c, g, or t
  misc_feature (2478692)..(2478701): n is a, c, g, or t
  misc_feature (2483715)..(2483724): n is a, c, g, or t
  misc_feature (2486960)..(2486969): n is a, c, g, or t
  misc_feature (2522220)..(2522229): n is a, c, g, or t
  misc_feature (2527389)..(2527398): n is a, c, g, or t
  misc_feature (2538134)..(2538143): n is a, c, g, or t
  misc_feature (2556819)..(2556828): n is a, c, g, or t
  misc_feature (2562189)..(2562198): n is a, c, g, or t
  misc_feature (2572924)..(2572933): n is a, c, g, or t
  misc_feature (2573598)..(2573607): n is a, c, g, or t
  misc_feature (2628000)..(2628009): n is a, c, g, or t
  misc_feature (2645807)..(2645816): n is a, c, g, or t
  misc_feature (2647442)..(2647451): n is a, c, g, or t
  misc_feature (2659488)..(2659497): n is a, c, g, or t
  misc_feature (2681517)..(2681526): n is a, c, g, or t
  misc_feature (2692146)..(2692155): n is a, c, g, or t
  misc_feature (2742333)..(2742342): n is a, c, g, or t
  misc_feature (2762779)..(2762788): n is a, c, g, or t
  misc_feature (2771056)..(2771065): n is a, c, g, or t
  misc_feature (2776788)..(2776797): n is a, c, g, or t
  misc_feature (2785658)..(2785667): n is a, c, g, or t
  misc_feature (2802090)..(2802099): n is a, c, g, or t
  misc_feature (2806511)..(2806520): n is a, c, g, or t
  misc_feature (2807153)..(2807162): n is a, c, g, or t
  misc_feature (2820333)..(2820342): n is a, c, g, or t
  misc_feature (2823185)..(2823194): n is a, c, g, or t
  misc_feature (2842706)..(2842715): n is a, c, g, or t
  misc_feature (2867923)..(2867932): n is a, c, g, or t
  misc_feature (2870297)..(2870306): n is a, c, g, or t
  misc_feature (2873414)..(2873423): n is a, c, g, or t
  misc_feature (2885842)..(2885851): n is a, c, g, or t
  misc_feature (2895378)..(2895387): n is a, c, g, or t
  misc_feature (2906405)..(2906414): n is a, c, g, or t
tgttgatcgtaataagttaatcacgacatttgttgacttgatcgatgggacgattcaaggactgcgtctacgggactttccagcgttttcagtgcaatttttcccagatggcgctcctggtccgactgaaacgcgcgatatttttgatgaatttgttgagtcgatgcaacaagcaagggggccaatctggtgaacaatcaagccttacaaaaagtgttgattatcggcgctgggcataatgacattggccgagagggacaacacgacgcggcggtgacccaaatcggtgcggcaattcggcgtctgggcattgctgttgtcctcgtcgataacaatgcttactccgtggcggctgaaaatcggtttgctgacaaggtttatttagaaccactgaccgtcgccgcactatccaaaattattgaaactgaacagcctgatggcctcattccttcacttggtggcgtccaaacagtcaccctaattcaagggttgattcgcaacaatgtgttaaaaaataatcacgtgaagttgctacagtgggatcaagacgtggtcgacatgattgtcaacccagcgctgatgagcaaccggttgaaagatatgggtgaacccgtgattgcctcacaagttgtggctagcacgactgaggcgatggccgtggtgcgccacgtcggttttccagtgatcgtcaagtcggtcgcaccccgaatcgaagcgagtcgccaactatgtgaagatgaagacgaactgcaacgggcactagcaatgggattcaaagtttcagggaccaaacaatgtattgtcgaacagagtatcgtcggctataaagaactcgaatttgtagccgtccgtgatcagaaggacaccgcgctactagtcagtgggatggaaaattttgatccagttgggattcactccgctgattcaatcgtttttgccccaacgcaaacgattacggatcaagaataccaacagtttcgctcagcgacactcaagatcatgcgcaagttacacttgaccggctcttgtcacgttcaatttgcacttgatccgaccacgcaaaactattacgtgattaaagtgacaccgtactttgatcggacgatggcgttagccgcgcgggcaaccgagtatccgttagcacaagttgttggtaatctaatggtcgggataagtttggcagaggtcaaactgcccggagcctaccgtaaacaaacagctttaattgaacccgttttagatcatattgtttgccggataccagtttggccgtttaatgtgttgaagaaagttagtcatcaactagacaccgtgacggaatcgacaggctcagtgatcggtattggtcgttcaacggaagaagccttgttgaaggggttgcggtctacggacgaatctcgctatcacgtgattgctaatcgaccccagaactattcggagggtgaactgatccaacggttgattcatccgcaagctgggcgcatgctgattttacttgaagccctgaatcgtggttatcaaatcgatgaattagccgagctaaccaagattgatgctttttacttttataaactgagtcatattttagaaattgaacgagccttgcgtgaacggccgtttgacgtccacgcgctgggccgagccaaatattttggctttaccgatgaagatgcggccgctgcctggcaaacggatgtggctaaggttcgcaactttgcgttggaaaatgaaattcaaccgacttttaaggaggtcgaaccgactgccggggaatttactgagcagacgagtacttattactccacgtacgaatttgataacgaaagtcaaccgtctactggtcggcgagtcgttgtcattggcacgggtgctaaccggatcggaaccaaccatgggaacgactatttggtctcacaactgttgttctacttgaaaaaggctgattatgagcctgttttgatcaacgctaatcctaatagtgtggcgatgactccgcgattggccaaaaaacgttacgttgaacctaaacagtattcggatattttaaacgtcttagcgattgaaaagccgttgatcgtttttaccacctatcatgattaccggctgggccagaagttagtacaggatggctaccaagtgatccaaatcaacaatagcttgccgcgcgagcagatcaggaccaacgattcgcccgccgtcgaggtgattacggacggcaccgatgtgacaatttttggggtaagtgaaattattgcgggaaataatttgcgtggcaatgtccgtggtgcggtccaagtatttccgattcgtgataaggcggaaaatcaggcaattacagctttacacgctgaaatcaagcaacgagtgctcgccatgggtgcgcccgggctctatacagttcggttagcaattgctgatacggctttgcaacttgctacgattgaaccgatgagcattgctacgatggcgttaatcagtaaggccagtgggtcgagcgtgacccgcttattacttcacgtaaaattaggcgaagcactgactaaggtgatgtacgactatccggatgttaaccggctaaagccagtctatgttcaggcgaatacatttccctacaatcatttacaaatttatgatgaagtggaagccaccggtgaaccgggccatgctaccggcacggtgattgcacatggcgacacgttaaaggcggcgttgacagcgttgaatcagggaaatgaagatacggatttttagtctgagcttttgatcaatatcgctatttaaagcacagccagactaaaatctggttgtgcttttttgcgcgttcgtaggcaaaagtaggctctaactggccaatgtataggacgctttaaatagcgctttcatttatggtatgcttatctaaagacaaattaaaggcaggttagttaaattggcaaagacattatatatgatgcggcatggtgaaacactttttaatcggctgaagaagattcagggggcgtgtgactcgccgctaacccccaaaggaattgcggatgcccaacgcgtgggtgcgtattttcaggcgcaagggattacgtttgatcatgcgtacagctcaacgcaggaacgagctagtgacacgttagaattagtgaccaagcaaccttatgagcgtttaaagggtatcaaagagtggaattttggcgttttcgaaggtgagtcggaagtgttaaatccaaaaccggaccccgtgcgccgcagtcatggtgactttttctgtcagtacggtggcgaaagtgatttgcaggtacaagaccgcgttgtcaaaacgttgacggcggtgatggcacgtccggatcatcatcaggtgttggcggtcagtcacggtggggctagcttcatgtttttgcggcaatggctttcaatggacgaaattgagcggcaaggcatcgtgttacataactgtgcagtcatcaagtaccagtatgacgcgggccgcttcacatttgaaaaaatcattaatttggctgcaactgataaaaattaaaattatgtcaactagatttaagtgcgttgacactcagtctgagtttaagcattaaaaagcgctcacgactcggattcaggcatgaaagcggggtcgtgaacgctgacgcatcaagggcgccaaaaggtcgtcatggtttgtttagtagtcatattatattgaatgatttctgcaagtagcttgtgattgattggcgcatcgaaagcaacttgccataacatcttggttgttttatcaccagcagccgtgatcgcgttccgatagctatccaaagtatgtgattcaagtgcaatgttcagatgatccttggcggtactgaacccaatgataaatgtgtcgtggtcagtaaacatcggttgattccaggcgacccgtgccttgagttgtggaaaagtcgtgtgtacccagttgagcaaggtaatcagttgggcgcgatggggtgttgcacccagcttttccagatatggtgtcaaaacagctaggtcagcgtcaaggtgctcagccattggcatttcctccattcattgatggcttcagtgtaccggatacccgcagagcttgcaaccaaaaataatcccgttcaatcaggtggcccacacggctgatcgaacgggattatttttaataccgcgcatttgagcccactacgattcagtgcacggttcgtttttattagttcattaggttccaatgccagtaaggatggcgatcgactctataaatgacagctggatcagcactccgaggccgcggttgtttcaccgtgatcgttaagacttgtgaatgacgcatagacatcagttcctttcttaattaatgtctttagtttacccatttgaagcagactcaactactgcgttttcataaggctaacataagaatttcttagaattgtactggcgagggccggcactacttggacagcggttacggtgtggttgcttgaagaaaggcgcaatctgatgagcgaacaaacaccggtaaataacactgattaagctagtgactcattcgcttcaaaaaaagacttgacgagcggtgtttaagctggataacaaatgcacataacgggccttgactatatggttaggctaagtattgtgttggttgttcccaacatgactggagttcattaaaaaaacgactgagatgatcgccatcaatggtggcatgattgaccgtaatgcttagcggcatgattgttttgtcagcgtccttcttaaactggccagcctgaaaaattggaaagaaactatctagtggtttgaatgggaggggcgtgtagctactaaagtggactcctggaagacagccgatattaaccagattaggtgtttgtggtgttttcggcatgggccctggaagtgcactaaattcagcttggtctgctaaatagtgttgatagaacgtttcaaaatcggtgtcgtaagtcgtccataaattagccattgtccggtcagcgtgtaagatcgtataagacggatgtaacacgtcaaaggtcaccagttgatcgttcaaatagccgatgcgcatttcgggatgtgtggtcaacaagcgactcactaggtatagatataccgcgttgaatttaacgtggtgggctttagtccaagctagggtggcggtaatatccatatttaccgtgagactaaaaccgctgggggctatcttggtgaaatagtaaaaataagtttggcgcggccaggcttcaggattaatagcaacggcgtgcatgtttggtttagtggtggtcatttagttttccttccaatctttagggcgccgattatagccatggtcatcgaatggttgtaaatcgtgcagccatttggttttgagtgctttgagcgtggcacgcatattagtaacatcggtcgtttccttttgccacagaatttgataggaaaagtcagcggcagtttgttgattccaatcagcctgtaacgggttggaccggtaaaagtttttattaagatttagttgataaaaggcccagcggttgtgtagattgggcactgtgtcaatccaaattttatgattgcgttcgttggtaatttgaatgacgccgtaataagttggggcaagtttgtatttttgttgtaagcgatgtttttcgactggttgcatggttcagtcctccttagtagttgtgcgccagtattgccggccatcgacggtacgctttaagaagccgtagtcgatcaggtaacggcgcagcgtggtgtaatcaaaataaatcggttgtaaatagtggttgagctcgtcttcattgattggccggttcatcggaatttcatcaataatccgcgttagaattgtgacgatcgtcttttgctttttgggccaccgcttcaattgtagtgggtcatgatcaaagttgaagtactgcttcaatgtttggaccgcttcgtcttcagtaatcgcaaagcggtcatcaataattccaggttgttctggcaggacaatcaaatcattgggcgtctgaccactctcaaagacggattgatagatggccaggtacaatttagcttgtttggctttttcacgaaatgtaaatttttgatgtcgaatcgtggccgccgctaattgaaattgtttagccaagtcggcatccttgatgccagtcgcaaaagcagtcagtaaattttgctgtttagtggttaaagtattgtagcgactcgctaagtgaatcagtggtgactggataccaccatggacgatcgttaagtgttgttcgatcgtggccgccgctgtagtcgtttcccagctagcatcacagtaattacaataccgggcagtggctgtttgatgccagccgcgttttaaatcatcaatcgttaaactagttaagtccatgaggctacctccaatgttactgattataagactgtttactgtatttgtaaacataatcgatgaattaatgtttactaaaatagtaaacttacaatcgtttgatatgtttcccgttacagtaaacacttagatttgccttgacaccaagatagctagcgcttacgcttaacgacgctgtttaaacgtgaaatgacgtgggacaatggcaatttatcaccgtgcatttggtgtttatgggattattggcgatgagcatgcgttggtcgttactaaaaagtttggtggtccctatacgaatcgctacgacttaccaggtggcagtttggccgatggtgagcccttacttgccgcgattcgccgtgagattcaagaagaaaccgggttaatcccgactgaattgacgcaattgggtatcacgaattttcggtatccctggcagttcaagcagtggcgaatgaaccaacatctggcggtcttttaccgagtgacccggacgactgggcagctggccgaacatgtcgctaactttgatggtcaagattcgcatggagcatcacgggtgccgttgcatgcgttgactgaagctaatgcgtcaccgctggttttaaaagcaaaggcagtgttgttatccgggcagtttgacccaagcgatcagacctacccggactggaccgtgctggatcatccggtttattgacctgagctaatcccggaatggcgccaaaaatttcatttcaaaagcgaaaaataggtgaacactaggttggcaatgtggctgatctagtgttcacctatttttgattcatgcgcacaactaatgcgtttaagcgggcgtgtgcttagtcctaatgtgacaaaaatgacgacgttgattggttagttaatcgtcgtttcgcgtggtgggggttaaaagtaccaaaatactggtgtgcgcccgagaaaaccaacatttaaatgaatagcgagctataattcagtaacgtctgaatggtgatctttcctaggcagggttacttatcgtttaaggagggacgcaacgtgtcgacagcttatgagaacgtttgccatcttgaaagagaggggatttaaatggccgatgcaattttaaccgttaaacatctgaataaaagttacggccaccagccagttttgcgtgacgttagttttgaatgcacccagggacggatcgtgggcctggtgggcgcgaatggcgctggaaaaacgacaattatgaaagcaattttagggctacttagcacggatggtgagattcaaatcgcaggtgaatcgatgcaattcgatcatcatcccatcttggcgacggtggggtcactaatcgagtatccgagtctttatccgtatatgagcggttgggacaacttgcgtttgtttgcggacgggcccgatgcccaagcgcgattggcggcggtggtgtccgcactaaacatgaccgactatatccatcaaaaaacgcgtcattattcattggggatgaaacaaaagcttggtgtcgccctggcctttttgaatcagccgcaactagtgattttggacgaaccgatgaatggtttggatccacaaggtactaaggagttacgcgattttatcttgaagcaaaaacaggcgggcgtcacgtttttgatttctagtcacattctcagtgaattgcaaaagctagcagacgatttagtcattatcgatcacggtaaaattattgagaaaacaacgatgacagcactgttaacgacgaccgatcattttgtcattgtgaaaactgatcatgacggtcaggcgaaagcggttttggtggcggccggctatcaagtagttgccgacacggttgtgaaagtccacttagcaccggaccatcaggtggcagatgtgctccatgttctgactagtcacggactgacggtcagggatgttcggcatgaggcggctgatttggaaagtacgattttaaaattactggcgacaaccagcgcctagggagtggtactgatgatgacgttatatcgacaagaactcacaaaactatttaagaagaagtctacgatttggtgtggactaatattggctaccgtagcgctgatctttgcgattttggcgcggatcaagccgacgatttttcccgccaaaaccatgtttgccgctaattttgaagcgcagcagttcatcgtcttctttatggtagcagcggcggccacgatgatcacgatggaatttcaatttgggacgatcaagcacgtgttaacgcagcgttattcacgaccactcgttttggttagtaagtggctcgtgctgttaacctacagtctattgttgtatgtcggtagcagtctgtttgccatcttacttaaagtctgcttagtaaatgataaatttgcgatctttacgcgggccaagttttggcatgattggttggcgggcgttggtggtgaatttctcaatacgtggttactgctaagtctagtgctgctaattgctgctcttttcaagagttctggtgcggcagtcgcggtcggaatcatcggatactttgttctgggaatggttaatattcccatgatcgcacttattcggaagtatacgtggctcaaatggaacccactcaacatgttcaacttttcagcccagttgggattaccgacgctgagtaaaattaccaatctcacggatgtccagttgttttggggcaatcttgcatacattattttattcttagtgttaggcctgctattctttcggcggcgggaagtttgaaccgttaccgtttgaagcactgccagtaagtactaaaaatcgcgcgtccagaaattttatcttggacgcgcgattttgttggttaatgattgatcactgcgtactcttaaaaccagtttacgcgtgcggtgtcagttgttcaacaagctcagcattgggagaaacgtacaatgttttctgaccttcatagatcacaaagccaggtttggcaccattgggcttgcgaattcggcgaacttggacgtaatcgaccggaacggttgctgaatcgcgggcttttgagaagtatgcggcgagattcgcggcttctgtgagcgtttggtcactaggatcatctgaatgaatgatgacgtgtgagcctgggattttttgtgtatgcagccaatagtcactcttacgggccgttttcaatgttaactgatcgttttgccggttgtttttaccgacaaagatcggcgtcccgtcactcgcagtaaattcctggggttgactcggtttacgtgaactgcgttgctttttcttagtcttgtgttgctttaagtagccttgttgcgtcaattcttcacgaatttcggtgatgtcagcgggactagcaagctcgatttgggtctggatattgtccagataatcaatttcagcttgggtcaagctgatctgctcaccaacgaagccaacggcatttttttgcttctgataacgcgaaaaatacttctgcgcgttccgggaaggcgagagctgattagatagttgaatctttaacggcgcgttatcgtgataatagtctggtaaagtgatctcagtcatcccacgtttgacttcatgtagataggtcgttaagatttcaccttttaaccgcagctcatcggcctgcttggtgttagctaaggttttttccaactttttgagcttattacgattcttcttcaggttatttttgaccacccgaatcagattgccggcttgttgttgaactcgttcccgttgggctgcgtctgcataataaaaatcaagcagactgctcaatgagtcgaactggcgcgtggctttgccaaaatggtcaaacggtcccgcggcaaacatggtcttatgatttggtaaggtgatcaacgtcgcctgcggctgatcaaactgtgccaaaaaggccagataatggtgatcaaggtcgccaggctgatgcaagtcggcagctaactgttgtgcgctatcacggccgaatccttgataatgctgctgcaattgttttgccaacacgtcttcgttggggtaatccgtgactaaggtgtgaaaatcagtattcggtgtaaatgggtcttgtttgtcttgcttggggggctcgatgtaggtcgcgcctggtagaagtaatcggtagcgattctgatccgcaccgacatgcttgatgacgtcaatgatcttaccagtctgattatcaactaggatcacgttactatgtcgtgccatgatttcaataatcaacgtcaatgtctcggcatcaccgagttcgttacgggtcgtcacggtcaggtgcacaacccggtcgttggcgacctgcgacacatcggtcacgatggcaccttgtaaatatttacgcatcatcattgcgaagttcgtcggcacggccggattaacgtaagggatttgtgttgtctgaatccgcgggtacgtcgggtcagccgatagtagaactgggtgattcttccggttggcacgaatggtcagaatcaactcgttttggtatggctgattaatttttgaaatacggccgccaactagtgtttggcgtaattcggtgaccatggcatgggtaaataaaccatcaaaggacatgtgatcactcgctttctaagatattcgttatcactgtaaaaatacagttaaccgggtactagtataccgtttttgaacaggtaaaaacaagttagcgccccacgctgacgcataaagttaggcgtcgacgctgctagttgtcaaacaagcaattagcggatgaacgctttgaatctaaaaatgttatatgcaaaaactactttaacggtattttaaataaaaagtagtcgtaattacacactctatattgtataatacaaatgtattcattgtgggtgctgctattcgcataagtgatggttaaagcgtgctaattacgatggaatcgcactggatcagccagtttacgctgaagcgtgcttgcgtcagcaaagctcagttgagtttttttgagtctaaaaaattagcacgtttttaatcatcaggcggggtaaatcaagtcacaatggaccaatgtgaattattgttgagaggaatgaactgtcatgaagtcaagtttaacggccttagcggaaatcgctaagttgcaaactgccatgttgaaaaaaattactaaggcccaaggaatcaccgttgcggaatggcaactgctgatccagttggcagcaggggccaatacgcaagaaaaattggcgacagccatgcagcttgatacatctacattaagtcggcaactggctagcctagtcaaaaaagaacgtttgagtaaggaagcgattggtcgtgaccgccgccaacttatttacacggtcacgccggcaggaacagcggcattgaccaagattaatgcggattatcaacagtttgaagcagaagtttttgacaaatggccacaagatgaacaaaaccttctccggattctgctcaatcggttaaacaagtcagttagccgaattctcgagccatgactttccaaacggtcgaaggtagagtataacttagttttatgctatgatatttgttattatttaaatgagaagtaggtgtaagtcatgaagattgctgttgttactgacagcacgagctatttgacaccgcaagaggtcgcggacaacgatattcatgtcgtgccgattccggttattatagatggaaaagtgtatcaagaaggtgtcgacattaaaacggccgacttttacacaaatatgaaatcatttaagtcgttcccaagtacgtcccaaccacccgtgggggaaatggtggcattctataaccgcttgggtgaacaaggttatgatgcagtcatcagtattcatcttgctagcacgatttccggtttttataatagcttgatgaacatgcgagatatggtcgataatatcaaactttatccgtatgactcccagatcacggtccgtctgatgggctatttggcaattgaagccgcgcggatggctaaagctggtcacagtgttgaagaaatcctggcacgcctagatgatctgcgggcctcgatgggcgaatactttatcgtggatgatttgcaaaatctggttcggggtggtcggttatcgaatgcgtcagccttcattggaagcgtgttacggatcaagccactgttgacttttgatgatcagagccatgaaatcgtcgcctttgagaaagttcgttcaactaagaaagctttagcgcgagttgagcacctctttgctgaagcacagtcaaaagtcgactatccgctgcgagcaattatcgttcaggggaataatttggctgccgctgaagattggaaacaaaagttacaacaaatttatccagacatgccgatcgatatcacgtactttggtccagtgattggggcccatttaggtgacaagtcattagcgttagcctggttgaaggacattgataaggcctactaaaatgaaaattattttttcagcatcaccagccaatcgggcagcggcctacgcgttacgtcaggctgtatttgttgaagagcgtggaatcagtgctgacgttgaatttgacgtcaaggatacagaccagcgtgaatacgctgttctatatttacagcctgatttaccaattacaacgttacgcttagaaccacaagctgaccacgtgatgcgatttggtcgagtctgcactcggaaggcctatcgcggtcatggttggggtcgtcaattattgacagcggctgaggagtgggccacgcaacgtggttttactcatggcgagattcatggtgaactcactgcccagcgcttttacgaactgtgtggttatcgagttacggccggcccgtatgatgaagatggggcccccgttgtgattatgcataagcaattattatgattcaactcgtagcgttggcattttgccagcgcttttttagggttttgccgttgactaacggggacaaaacacggaaaatggactaaattaaacaagtagtggaggagtggcgcaatgattcaaaaaacgagggccgaacttaaaaccgaaattaagcaactctttaaggggcgttggaaagatgccatcttattatgtattattattagcttattaacgattttcggggtgatggccaattattcagatcgcgtgtcgtcgggcagttccacgactgacgacacgacttttaagcagttggggaccttgactggttctgatatatcgttgattttagctgtaatagctgggtttttactggttcaagttggtgtctggctggtcgttcaaatctttcggattgggacgagttatgcgatgttggactgggtccgacaaccagaacgccagatccatccggtcagtgactcaacggtcgggttcacgaaacgttatgggtgggcactggtcggtctgattatttataaaactgtgcttatcttcctatggagcctgctattggtggttccgggtattattaaggcgtacgcttattcacagactttttatgcgtataaggacttgttaactgcaacacctgctggtcaagcacggccacgctatcgtgatgcggtcacccgtagccgtcagttgatgcacgggcacaagtggcagttattcgtgttgcatttaagctttttgggctgggaacttctcagtatcttaacggctggaatcggccagttatggttggtaccatatatttatggtgtacttgccaactattatgataatttacaagcaattaattaatgaacgtcgatattaaaaatcgacacaaataatattgtttcttttattaagcattaagacaagcccgccaaaatatggtaaactggcggaagcaagaaaggaagtgcgatagttaatgcctgaacaaaaacagacgcgcatgtcacgcttaaaagcgcgagaggctacgggtggcaagcggggacgtaaggcgagttcacagggatcccatgcacctaaggaaccgaacgatccaaagaaaccgcaagcacctaagtcaccgcaaaaaaaacatcacgtttcgttatggctattggctttaatcgtgattgcgctcggtggaacagtcgtttactttgtcaaagcagctagcaaccaagacttagtcgaaaccacgagttcctcaagtagcagcaaggcgcgcaaaaaatcatcttcgaagaaatcatctagctcatcgaagaaaaagaagaagcattcaagctcaagtagtgaaagtactagcgaaacgacggctgcaagtacggatgccgacactagcacagatgggacagaaacgacgggtgcgtatagcagttcaactgccactaatacgaccgctggcaatacgacagctagttcgcatagcacgacgaccagtcatcaaacgaccacaagtagcgccacctctcacagtacttcaacagccagcagctcatcaaagagtgaaacggcgtcaactagtactgaaaagagtagcagtagtagtcatgccggctcgatatacgataatttaaatgacgcgaaggactatggtgaaaactcaatcagtgggaactataaggtcacgacggatagcaatggctcgtaccacgtgtcaaaggctgattaattttaattgcaatcatgatgtttgagctgggcttttgcgaccgttttcggtataatagccttaaaatgattgtaagaagtgagtgataaaattgaatcacaattatgtggaagttaagtatccagccatttttcgtgatgaaggcacctactggaatgtccgttttccagacgtgcctgccgcccagacctttggggcgagtgtccaagttgctgcggacaatgcggcgaacgcgttggctattgcgctctttgaacaatcactcccgccggcgtcggatccgcagtactggcggttggcttcaacggaatttgttgtttggatcacgatggcggatgtccagtttggtccgggcgctgatacaccggaaccaatgaactaatgcgtataaaaggcaaacgggtcggcacctaattggtgtttcggacccgttttcttatttcatgaaagaagttgagaaaccttgccaaaccagccactaatctttgatacggccattgcgaaggataagccagaaaatatccggcacccgcacaatgcctgtcctttttgcgatccgggccagttgactgatattatcgcgcaagatgcagatcgtatctggctattgaataaatttccgaccttgcaagctacctggcaaacgatcgtgatcgaggcggcccgccatgatggcgatattgctacttactcatccgcacaaaaccgcgctgtcttcgcgtttgctctgaagcactggcaagccacaattgcgagtggtcggttcaaatcggtgttgtgctataaaaattttggcccacactcgggtggaagtttacggcatccacacatgcaaatcgttggtttaatggccgccgatggttacgctaacgtgacagcagccaatttgactggctattcagtgttggcggtcgatcaggtccaagtaactgtttctgatcggcctatcatgggatttgtcgaaatcaacgttgctgctccagctaccgcgattgcaccgttagccgatgctgtgcaacaggtcgtccagtatacgctaaatacgtattttcatgggcagtgtgatagttataacctatttttctatccgcgggatgaccagattgttgccaaagtggtcccactatttaatgtctcaccatactatatcggctatcggctggcacaagcagatacgccaaagcgaatgcgcaccatcgctgaggaaattcggcaacagtttgaacgatcgaatctggctcactcaaactagctaataggccgaacagccccaaacgacggaaaaggcccccaggaatcctttcgattctcgggggccttcactttaccgttcacgtgcatgattaatggtgacgcaattgcgattagtatggggtggtcaaaagcaaccggtcaagtcgtgggggaacatctctcagcagtaatgtcagtgattagttatggttttcaatgctggacggcccttcgccgggcatagccgtaaagactcagcaaggcgatcaatgtcagcaggccacagctaccgaaagtaacggcaaaccccacccgttgaattaaccagccaatcagaggaaaagcgctgatcatcgctaaactaaagaccatgctggcaacgctcagtagggttgcccgttgcccgtttggaatcagctgattgtagtagttggaaaacagtggctcaatcagtgccatcaaactattgatgactaaatagatgaggaccagtagaccgatggcgtgactaaatgcgctaagtagggccataatcatgcttaggcagagcccgtaaagtaactgatgttgggtttgatgtcgctgtagccaaggtgtcagttggatcgccacaatattgagggccatactcgcaatgaggatcgtcgtgattagtctcccactaaagtgctgagcagtcatcactgtttgaaagtaatagtaataagttgttccgagtgccgaaaagagcgcgtcaaagatcattaaaagccgtaaacgacgttgggtcactaacagatgcgcggcagcacgaaggatcgttcgtaacgacggttgtgttgaatgagtcttggtcaactggcgctggggaacgtgcagcccactgattgccagaatggcaatgagagctgccgctaaatagacccagtacgtcactgaaagatgctggggcattaaccagccagccaacacgacacccaacgtatcggccacttcgattgtcgtgttgagaatcgtcgtgacgcgtggataatgttgcgtggcctgagtattgacgagactgtcatattgtgccgcttcaatcgtaccagactggagattatacgcccaggcttgtaggatgaatgctaggagcaaccagccgagactgtgagccgtcaacatgatgagggcgtgtccgatagccatcaggcggctaatgatcaggacaggccgataaccaaagcggtcggcgataacgccggagggaacttccgagagaaaactagtcagatgaaaaacactttcacatagccctatctcaacgagtgatatgccttgttgctgtaaaaagatcacccagagggtgttgataccaaaaaaagcacaggccgcataaccataactgagggttaggttacgacgggtaagtggtgataacatattggactcctttagcggccacgagcggacaaaaaaagacgacccattgtcgtcagctgctcgtgacttcgcaatggctagtggtcattcaacttggaaaaagcgcagactgcgcccctgacataaccataactgcaaaaattgtgcgcttaaggttaatccaagctgaaaatttagccaacacgtcattcaccactttctaataatctcattttcttatcataacaataccatatcaatttctgactgacaactgataccgataagtttgaatgcctgatattagttgtgattgtggtatgatgttaagtaaatgaacaaaagtggaggaataattatgcaaaatttgattccaggagacatgttggaagttaatcaaaaacttaagtgggaattagacgcgggaatgactgcggatgaaagtagcgtgattaatgaagctgtgctggcgggaactcagtacttcgtcgatgaggccttagaaggtagttactggacagttaagtgggctgcagatggtcagactatcgaactctatgggacaactggcaccgtcgttggccgcattaaaccgttgtctgccacgttagaaaatgattttcgacaggattcacaaggcttatttatccggattgaaaaagaggtcgcagtgattgttcgtgataactaagccgaattgagtaatgaggtgattagcatgtttgatcaagatgaagaacggtttgcaacgctagggttagccgccaagctaccgagcgcggtgattgatggcatttgggatattattgatcaaaatctaaagggggtcgttcgcctgccacgggtcctgcaatttgccctgatcgcacgtaatgggcaagtcaccgtggcttttgatgcgcagcacgatgccatcatggaattcgatttaccagtcaattaccaacgggagtttcccgagacggtggcagtcttagacgatggtcagtatcagaccatgatgttgatggacgaactctccgtctgaacgcagcgattattcaatgagctgaatacgaggaaactcgtcacttcaggccggcgaataatcgctttttgattggtggtctttaactgggcagatgcgccttaaatttgtataattaaatagatggtgtgaggtgtggttttgcgatgttaggttccggttgctaatcaagggggccgcattgttcacgtaattctcacgccgggatcagagaaaggtgtgtgtctaatggcgaaaacagcagtgtgcattgtcgatcaacaacgttaccaagttgtggacggtatgcgattagaagaattggaaactagtttgcggcaaatgattttaaaagattttccgcaggcccataatagcagtttcatttgtagtgagcatctcgtacattatcgcttagcaaagatggatgcgatgatcgagaacgattatcaacaaaatgataaggtcaatgcgcaattatctaagattctcgctaaccacacgtatcgggtcgtcgatgttaatagcgagctggaaagttcattgacatttggtcaacgggtcgcggatggggtcgcacggttcggggggagctgggcgtttatcatttcgtttgtcgtggtgatgctcgtgtggatgttgctcaacgtcttaccaatttttagccatcattttgacccttatccctttattttattaaatttatttttaagcatggtcgcagcaatccaggcaccattgatcatgatgagtcagaatcgggcagctgagtatgatcggctacaagcggccaatgattttaaagtgaactcgatgtctgaagaggagatccgggtcctgcactcgaaagtcgatcatttaattcaacaagatgaaccaaacatgcttgaaatccagaaaatgcaaacacaaatgttaggtgagattcaagcacaagtcaacgaattgcgacgattgcagccgcggcgacgtcgcaatcaaagttaaggtggctgattgagtagttaaccaaaaaaactgagcgcctggaattttcacattccgacgctcagttttttggttaaccgtgaccgcacaacggcattcgtcaagattgccaacggtcagtggcactatttatatttactttctaaagcactcatccagtaacccagcgcgattcccacagcaagagctatggcgctgaataggtaggtactgagtgtggcatgcgcatatgagatactctcagccgcatatggattcggaatcaatatcagcatggtactagccagaacaatacctaatatgaaatggtagactcgggaatgaaacttcactaataggtgatccatcaacttcgagaacaacgccatcgccaggatgccaccgatggcgatcggtaagtagacgcctacgatatctagtcttttaaagcccgtcagcatgggtgtgaaaaggcctaaaataagtagcaagttggaaggactcagtcccggcactaagacgcccaaggtaatcagcgctcccgcaacgatgaaaccaccaaagttagcgggcaaggtcccaaacagctcactcataaagtaaagtaggccggcactaataatgaaggtcccgaagaaccaaactccgtcgagccagtcacgtggcgcccgactagttgcagttttcatcagggctggtaaggtcccgatgatggcccctgcgaacccccagagaacgatcacctgagcgtgtgcaagtaagtattccagcggggcggaaagcagggcaatcccgacgatgcctcctaatccgacggggacaaagtaccagaagtcccgtttaaagttacgacggaagtgggccataaagcccaacagtcgctcgtaaataccgagaatggcggcgagaaccccacctgagacgcccggtaaaataaaaccgagggcgatgacgacgcccttgaagaatcttttccagaaagtatcagttgttttagttggcataagtaaactcctttagctctaatgactggtattccagtaataatcaaagtaattaaagataccagaaaaaatcctgcatggcaattaaaacccgttttttacggttgccttcggtggcaaaagttgcacggcggattattttatcataaaatgaatggacgtgaaaaaatctgtattttnnnnnnnnnntaagggaagctgatcttttttgtccgaacagcgtcggattaattttacaatctaccccttacttgatgttttcacagaatccgtgtattctcttatttaaagtaaaacctacttttattttgctcgtttaaaagtacttggtacttttattaattgaagggagcttgcatttattatggataacacgcaacaacgccccacgttcatcttcttaattattggcacggcttggttatttgatgccatggacgtcgggttgctatcatttattatgcccatcgtccatcagcaatgggcactatctaattcacaaaccggcctgattagttcagtcagcaccattggcatggtctgtggtggattttactttggccacttagccgatcggattggccgcaagaataccttgatcgccaccttgctgacattctcaatcggcaacctgattttggccatctcaccaggtttttacacatttttaggcattcgcttcttcgttggcatggggcttggcggggaattaccggttgcggccacctacattgccgacatttacagggggactaaacgttcgcagatgctaattctggcagatagtttttgggccctcggctggttggtggcgtcatttttatcatttctcctaacgccggttctaggatggcggggaattcttgtggtaaccgcaatcgccggggtttttgcaattgttttacgaaaacacattcatgaaacagcaccgaagagcaccggaactcaacactggcttgttagtctgaaaaccacttttaaaccctggacactgatgctttggcttgcttggtttatggtgatgttcagttactacggtatgttcatgtggttaccaagtatcatggttgataagggctatggtatcgtgaacagctttggttacaccacgatcatcgtcgttgcccaattaccggggtacctctgcgcatcgtggttagccaagcgcattcgggtcaagtacgtctttgccatttatatgctgggaacggcctttggcgccatcatgtttggccaatcagcgtcagcccttctcatcgtgatttctggctgtgtcctttccttctttaacttaggggcatacggggccattatcgcattgacgccggaactctatgctcacaatattcggggaaccatgaccggcatggcgcaaggaattggccgcatcggcgcaatctttggccccctcttaattggggtcttaatggatcaccaaattagtattagtattatcttcgtcatttttatggtttcactgttgatcggttcgattgccgttttggcattgcccagcgctgatcagcaacctaacggggaggtcacccaatgaatcctatcgtcttaaaggaaaaaatcagcgaatttttgaaagaagatttaggtttcggggatctcagtgtcgcgtttctgccaggcggaacccccctatctggatcatttatcgccaagcagagtggcattatttgcggtcaagaaattccccaggcaacttatgacttactgggtcacgcaacctataaaccacgaattccggacggcgctccggttaaggccggcgacatcattggcacagtttccgggacagcccaaaccctactatctggtgaacgggtcacccttaacttaattcagcgaatgagcgggattgccacccagacgacacacttcgtcaagctattggacgatgcgaccattcgaattacggatactcgtaaaactgctcccggcttgcgattatttgataagtacgccgtcagcgttggcggcggcttcaatcaccgttttgacctaactggcgggattatgttaaaggacaaccatattgccttagcgggtggggtgacccaggcgcttgcggccgttaaacggcatgtcggccccctcaccccagttgaggtcgaagtggaaaccgaagaagaacttcgccaagccgttgctggcggtgccaatgtcatcatgtttgataatcagaaccctgaaacgatcaagcagtggcgccagctcgtcccaaaaacgattaaggtcgaagcatctggagggatcaccgccgaatcaatcagcacctttaagggctgcggcgccgacttcatttcgattggcaatctaaccaacgacgtgacaccactcgatatcagttttctggttgccggagccgttaaaagttagcccaatacggttagcgcttcgcagaatttaaacagaccaattggatccttcaatcgattaaatcgttgacggtctttatctttttattaagatttatcaataacctccgcgccatttattgacataggagcattaatgggaataacagcctaagatatttggagttcagagagggcgcgtttgattttcaaacttcgcaacagaaccgattattttatcataaaatgaatgatctgtatttttatgaaaattattatcaaattggattaaaggaaagttgaggtcatatggaaaatcagcaacttgcccgtaaactaaaacgccgtcacgtgcagatgattgcgcttggtggcgcgattggaaccgggctctttttaggctccggttcagcaatcaaacaggcggggccgtcgatcttgttggcttatgccattggcggtttcttctgttacttgatgatgcgagcactgggcgagctattgttgtcggatacgcgcttacattcgtttctagaattcattaatcgatatttaggtaaacgtttcgagtttgccattgggtggacctattggctctgctggatcagtttagctatggctgacttgactgcgagtggtatctacattcgttactggtttccgtggatcccgcagtgggtgacacccttaataattattttgattttattagtattcaatatgctctccgtcagtgcgtttggcgaactagaatattggttttcgatgattaaagtggtggctatcattgctttgatcgtgacgggggctatcttgattggttcatcggcccatgtcggtgggcaaacggtctcggtgacaaatttggtcagtcacgggggcttcttcccaacaggcgtccagggcttcttgatgtcgttttcgctcgttatctttgcgtttacgggcatcgaaatggtcggaattacagctggggaagcggaaaacccagaaaaagaattaccacgggccatcaatagcttacccattcgaatctcattcttctacgtgggcgctttattcgtgatcatggcaatttatccttgggatcagatcacgaccagtcagtcaccctttgtgcaagttttcagcgacgttgggatcaaagccgcggccagcattatcaacttcgtggttctgaccgcggcgctctcggcttgtaatagtgccatcttcagtacgagtcgaacactatttacacttgcgcacggtgacaacgcgccgaaatggatgggaaaggtcaatcgttacaacgttcccgcccgctcattgttattctcatcattgatcttattggtgatcgtggcgttgaattacgtgattccaagtaccgtcttcacgttgatctctaacgtggcaacgaccaacttcatcattgtttggtgtgccttgttggtgtgccattacgtttacaaacgaaccactgacagtacgcataatccgtttaaactgccactgttccctgtttccaacatcgcgaccttggccttctttatcgcggtgacggtcgtcttgtgctttgatcaagtcaaccgttgggcagtcatcggttcagtcgtttggttcgtcattttattagtcatcgaacgaagtatgcatcgcaccgtttaaaaacgataattgtaatcaccggtcatcagtcttggtaaacccaattagtttaccagctaatggccggnnnnnnnnnnagtttaccagctaatggccggcgatttttgtaaggtgcaataatcacccctaatagtgcattctattctataattaagtcaaacatcatggacgttgctgacgaccacgtatcagccgtgacatgattattggggaggggaacagtatgaattatcgcaacttgctcgtattaccacttgccgtcttgttggtcggctgttcatcaccaacacaccaggattccaagtcaactagtcagacgaccacgagtgccaaggcaacggttagcagcacccaaaagaaggctaaggctaccagtagtactagtagtcggcctcaaaccgcagccacgcgctcgtctagaacagcgcgtgagcgggccgccagcgccgctaacaagtcggtcacccagcccacggctacgacccggctggcagcattgaatcaacaattgactaagacgttgggaaagcaggcgctcgttccacaagtcgatgggttaactagtggcagttcgaagttgaacatgcgctattcaggtgacgcagccaattacaccatcaattatagtgtgggacaacaggcccagccattcaacgcggcggccgtggtggatgaaacggcttatgcgactgtcactaagacgacctatgcgacaactaatgccgcggcccagcaggtgggttatcgtgataataaatccacagcagggctgccaaccgtcgatctcggtcatcaaatcaccgcgcatatcgacgcgggtgctggtcaacgatatatcatgtggaatgagggccgctggtcgttgaccgtgcatgcgaacatgatgcacgaagatgcgggcgtcgcgttagctaaacaggccgtcgctactttcgagcaggtctacttaccagcaccacagtcggtcggcgccatcacttttgacgcgatttcgtcaggctctggacctttagaccaagttatccaatggcaagctggtaaagtggtttatcaagtcaaggctcaagagatggcaacggctatcaaaatggctgccagtatgcaataatcaataactagtttctacgctcgttaaattaagcagtgagctgacaaacaaaagtagcagcgtaatcagccagagatggctagtacactgctacttttgttggttaggcgttattttcatctcattcgactgccagctggtgaatcgcgactattgatcagtcggagattggcgcagttgttgttcgatgggctgcgtcgcttttaagataagtgcttggtcactcagcgagatgatacggtggtgggtgatcacggcagaatcagttaatgcttggtaaacagccgctgcaaccacccaacaagtatcggtgtcgtaatcacgcgcatgcagtaaatcataaccgtcactcatatctaggtagacttgaaagccgatacctagccgcgcctgtaatcgtttcgcataacgttgataaagcgcgcgattggcctcagggtcgggggtcggcccgataatccgttcaccgagttgtaagtttggcactaagcgcacttgcatgtcggtgcctcctttgcgttgaaaattataatcctattttagtctaatccattcatgaaataaaggcactaatcagccgcagttaaggtgattagtgcctttatacgcattcagttaagctaagagacgtaatagtagccacccggcgacgccaattaacagggcgtaacccagacctggtagtagtgttttacgtaagatggcgccttcttgaccactcaggccaacgactgagctgacagcaacgatattatggacacagaccatattgccggctgccgcaccgacgagctgggctgccaagataatcgtgggcttcaaactcgcattggccgcaatatcagcttgaatttgcgcaaaagtcagtgtcgagaccgtggtactaccagttacgaacgcccctaattggcctaggaatggtgccatgatgacccaaacaccagctagataggtcgcgataaacttggcgatatacattggcatgctgggtaggttggcctgattcaagccagaattagtgaagacttgaaccatgatcagagtaacaccgagggcaattgcggtgttgcccatcgaacggatgaccgaatgggcagttggtagtaagggctttaatgaacgggcttgtactagtaacccaatgatggccgctaccgccaagattgtccctggcgaatagaggagttcccaatcagagttgatttgactataacctagaatgtgggaccacgataagttagcataacgggtcaaaacctgtttgattggtgtcacgacccggctagcgagtaatagcacaacgaccaacaggtaaggaaaccaagcggtcatcaggttcatcggactaggcgcaggcgtctgggctgccatcccgttcgtccgccatggcgtcaactggctcgactttggtaacaaccagtgcaatcggatcgtgatgatggcaataaccagcgttcccagcggtgcgatgattgaaacaaattcataacccactagccaagcactgaggagtgccagtagactgtaaacgaaaccgatcactaacgcccaaggtaagacggaaagccagcttttcaagcggtgtgccttagggccaaaccacatgatgagaattaaaatgagcaccgctggcattagcgcaccaacgaataaatcgagttgcgtgatgcgcaggccaatcaagttcaagacggatgctttttcggtcacattactcagtcccacggtcaatggtgttccaacggcgccgaacgctgcgggggtcgagtcagccactaaggccaagataacggccgccatgggtgaaaagccgagtgcaattagtaatggtgcagtgaccatcgctggggtcccgaagcccgagacaccttcaatcaagcccccaaataggaaggctaccaaaacggtttgtagccgcatgtcagcagacaaactttgaaagccctggttaatccggtcgattgcaccagtggcacgcaaacagttgagcatgagtaaggcgccaaataagatccataagatggggagggctttatgaatcgcctgcaaaattgaggcggtgaggaccgttggactaatctgccagaaaaagtagccggtaataatcaccaccagagcgctaatggtcattccacgggtcgcggataaattcaggcccccgagaagaatcagtggcaggatgattgcagcacttgcaataaaaatcatggtcgtaaagcctccttagatggtgcctagtcgtttgactgtgctcgtttgaaataatactgaccgtagagcgtgaccagcgtaacaatcagagaaatcgccgttaagggccaaaccatccctactagataagtgttcttcaaagcggttgaagctggattgaagaaattgagcaagtttaattgtcgaaaactgctaacaattactaagaggccgaagaaacacagttgacaaaacaggcccccataagtggaaaagcgatatttatgaataattgcgagatctggatcatcaacctcagtggcataaacgctagtattaatggctgggttttcaaaaccgacgtacaacgagatcaggagcaaaccggcaacatataaaacgggttgggccgtggcaactaacaaatggccgacaatcaagccaccgcgcgcaatcgtggtggcacgatgtaagtcatgccgtcccaataataaatatagtggccggccagtctcaaagcccaacaaatagatggcgaagaccaggtacatccccattttgccaaagacaaagacaccgaagaaactattaaacagtaggacaaaactcagtaaaaagccccgatcaacgatccgtagtttgttagccggcatggattgccaatcagcagctagttctagatttagtagaacaatggccacgacgataattcctaatacggccggtagtgcgatttgtaggctcgccttacgaagtaacgtcagtaaaccaatcgcagcaaagaagacgataaagaccacaacgcgccacggcttgatgggacgtacttgggccatttcgtgttgatcgtaaaatgcgagcgaaaactgactcaacaaacggccagcaggcaacgcaatgataaatagtagcgccagtaggataaaggcaagccggtaaccccagttcagcgcaaaatctagcacaaagagaatgccgagaactaagaaaattaaccagtaaattttctttaacttaaaatccgtctgcgcggacaagtgtaacttgatcgtcaagtaatagggccagatgttggcggatgtatatcctaagaatagggccccagccagcacggccacgatgttagccgtcaaactgaacaacaagctaccaagcgcacccagccagaggcaaatgagcaaataactactagccttgaggtttaggtgtttagtcccaaagacgctcgccgcccgggccacgtagaagaccacgatcgcagctaagtaattcgcgttgtgggtctgctgatacttaaagagaattagaacgtagggcaggacaataccgacgttagccaagaagttaagcgtcgcgacagagaagtccaacccagagtttcgtagacgagtcaaagataatcacaaccatttcgttagtttttctaggcctagtataccaattaatgcacataaatggtgttaaaaggtatgtttaggcacttttacctgtaaattgagcgccgggatacgtagatatatttaagccaatcgtataatcttactttaaccaaataaataaaaaaacaattcttaccaggaacgtcacacttctttcatatttattcacaaaaaacataaaattcttatttatcattatccacataatttaaataatgaatggggtcatgtagatatgatttatgcacaaatattagccggcggtaaaggaactcgtatgggcaatgttccgatgccaaagcaattcttgctgcttgccgacaaaccaatcttaatccataccatcgaaaaatttacacttgaaagtcgctttgatgccattttggtcgtctgtccagccgattgggtcagccatactgaagatatcattaaaaagtacatcaccgatgagcgcgttcacgttgtcgttggtggggccgaccgtaacgaaacactaatgagtggaatcaactatatccaagatcattacgggattcaagacgatgatgttgttgttacccatgacgcagttcggccgttcatcacacaacgtatcattaacgacaatatcgtcgccgttttagaaaataaagcagtcgatactgtcgtcccagcaatcgatacaatcgtccgcggtgctaatgatcaggtgaccgatattccggttcgttccgaaatgtatcagggtcaaacccctcaaagttttcacatcaaaacattgatcgactcatataacgcactcagctccgaacaaaaggcatcactgtctgattcatgcaaaatctgctcgctggctggtcaaaaggttagtttagtacgtggtgaaaattataattttaaaatcacaacgccgtttgacttacgcgttgcatcagcattagtagaaaagaggtcataagatgttaaatcaagtttatcgcttagtaagtccccgtcaatttgaagttgaaacggtcgccgaagaggtagacgccgatgatttgatcgtgcggccaaagttcttatcgatctgccatgctgacacgcgctatttctttggccaacgctcccaagccgcattacgtgctaagctaccaatggcgctgatccatgaggccgtgggtgaggtcgtttatgatcctcgaaatgagtataagcctgggacgctcgtcgcaatggtgcctaatacgcccgttaagaaggattcaatcattcaggaaaattatttaccttcttcaagattccgttcaagcggctacgacggctttatgcaagaatatgtttgtttacgacgcgaccgcgcaatcaccgtgccaagcgacttcgatccacacatggccgcattcattgagatggtctcggtcggcgttcaagcattaaccaagcttgaaagtaccatggatgaggaccaacgggttatcggtatttggggcgatggtaacttgggctatattacagcgactctggttaagcaaatttttccagacagtcagttgctggtattcggtcggcatcaatccaagttagattatttctcatttgcagacaaaacttacctggtcgatgacattccagccgatgtcaaggtcagtcaggccttagaatgtaccggcggccagggcagtgaagcagcgattcaacaaattatccagcatattcaaccgatgggaactgccattctaatgggcgtctctgaaaacccagtcggtatcgatacccggtctgtccttgcagaaggattgacgttacgaggcgtcagtcgcagcagccgtgaagattttaaacgtgccgttgatattttatcctccagtccagtcactcgcgaacggttgcaaaatttagttggctacgttcaaaaagtgagttccattcaagacattaccaacttctttgatagtgcacttactaattattggggcaaggaggtgatggaatgggacgtctaaagacggtaaagctcgtgttactacacacgagctttaatttattctatcaatttttttataaagtgtttggcccgaagaagggacggatcacacttgccacgatgcgcagcggtcaattaaacgacaatttggcagctcttgagcagggcctaaaaactgccaacgttaaaccggttactgtgttttgctatcattatgaccgcaccctggctggaaaagtgggcttcttgctcgcctccattaaagcgctatacgtgattgccagggctgacgtctttgtgatcgatgattacttttttccactttacgcaattcacaaacatgatgataatcaagtggtacaattatggcatgccattggttcattgaaaaagtttggcctcagcttaccgaatgctgatcagagcgtcatgaagccgcacacaaattatgattgggtcttgatcaatgcaaagtctgatcagcctgcttatctagatgccatggctatcaatcaagatcacgtcattgccactggatcgccaatggtcgactcgttgcttaatcgacaaccacaacaaccgcggctcgccgcccgtcgtattctatactcaccgacttatcggcaaggtgtccagggtaagcagcaagtcatgggatatgtcaacaacatgattgcggcctgtcagcagctgaccggtccatgggaactgtacatttcgctgcatccgtacttaaaactgtcagcgatgacgctaccatccaacgtgcatatcttccaagatgctgagcgggttaagacgctgatgccaacgattgatttatttataaccgattattcgtcattatcattgacgtttagttattttgaacgaccaatcattctgtatacgcctgattatgatgattatatgcaaacatctggattctatgtcgattactatcaatatttgcaagcaccgcacttcagcaaagcggcgcgagttgtcgattttattaatcaggaagttgatcatatggatctatcttatgtacatgaattaaagcaaaagacatttccacatcaagatgggcataataccgaacgggtcgttcaatttgttgaaaaattagcagggggagaacattagatgatacaacgactaaaacgaatcgcgcgtcgcatcgtatacggacggaatcaaccgcaatatactcgtaatcgtgaactggttgaggacgcacaaacgaccaaggaagacgttgattttctaaatacattgcgaattgagaaagatgccgaatcattgatcaaacgtcaagtgactaagctggaattcaacagttcttacttagtgattgagggaatggcgtggtttgaaaagtatcccgaacaagatactgaacgaattattaaaagcttaattttgactagcaagacgaatgaagaattagaaattccgttgatcaacgttcgtggtcaaaacgctgattttccatatgccgggtatcatggtgacatcaacttttcgacactcagtgagggtaaaccgctaacgccaggcacttatgaaatcaagatacaattaaaacagtatctaggtaatggttggattatcagacgaacctccattggtcaagtggtggaaacacagcaagacttaaattatacgactaaaatgacaagctattcagcgaaaagcaataagtcatacagtctaatttttcggtataatttagccgcccaagccttaaaggtcacttcatataaactgagtgatgtcaacccgcttgaaaatgagtttactgaagatgtcgggttagatagtgtagcgatgcgtgccattaaacgccgggcgctaaaactctggtatcggtggtactgccttcaaccgattcataagaaacaaatttcatttgtttccgatagtcgggtgacaatctccggtaatttcgagtttatctaccaggaattaaaacgtcgcaatactgattttaagatttcattctatttgaagccaagtattaaaaccaaaaaatcctggaaagaggttcgaacgttggctaaagcgttggctactagtcgctatgtgattttagatgacttttacccactagtttacccattgcatatccgggaaaatgcggatttgattcaggtatggcatgcggtcggtgcctttaaaacatttggttacagccggttggggatgcctggtggtcctaaggttcaatcgttaaatcatcgcaattacaccaaagccttggtttcttcgcataacatcgcggataaatacgcggaaggatttggaattgcgccggataagattcagccgctaggaattccgcggacggatatctttttcgatgagcccaagaaacaggcaatccgggaacggctcgcgcaagatttgccattcatcaagggcaaaaaagtcattctctttgccccaacatttcgtggcaatggtcagcaatcagcatactatccctttgaaatgttgaattttagagcaatctacgaagcgttacacgaagattacgtctttttactgaagattcatccgtttgtgcaaaacaaaccaacgttaccatatgaatattcggacttctattacgatgtttctgattatcgtgagatcaacgatttattactcgttgctgaccaattaatcactgactactcatcagtttgtttcgaatacgcactactgaaccggccaatgattttctttgcgccagacttagcggattacatgcaatcccggagcttttacttcaactactttgattttattcctggtagtttagcggaaaacacgggtgagttgatcaaccagttgcaacatccacaagttgaccaagctaaattggacggctttgtgaacttcttctttgatgatctagatggtaagtcgacagctcgtttcgtggatgcgcttgaaaatgacttcgaggatccgaacgcagctgagttagaaaataacgacggtctcgccattagtgaagatggtaagattatccctgattggggtaaaaaggctaaataatatgttaagataaagcagtcagtcacatcattagcgcatttacagcgttgattgtgtgaccgactgtttttgctaggaaactataggaggaattgatcatgtcacaaattacgacacggcggctcaccactgctgacgtgaacaaactacaacaaatcagtattgaaacctttaaggacacgtttggtgcacaaaacacctctgaaaatatggccgcatacttacaagatgcatataacttgcccaagttaacccatgaattagcggaacccgaatcacaattttattttgttgaacgagccggtgaatcattaggatacttgaaattaaacaccggtgcggcacaatcagaagcaatgggtccagacactttagaagtcgaacgaatctatatccgaaaagctttccaacaccaagggctcggtaatcaatttatgcaacaagcgattcaaattgctaaagctgatcataagcagaagatctggcttggtgtttgggagcataacgaacccgcgaagggcttctatgcgaagtggggctttgaacaattcagtgctcacgattttgtgatgggggacgatcgccaaaccgatttgctcatgatcaagtcactgacccaagactaagggcagtaaaggcttttgagtgaactgcttttacaagtttagaattagtcgctgtctgtggcgaccagcagattacaaatttatttaccccttgttttttacgggcaaggggcttatactgataatcaatcgcacacgattgaaaggagcatccgcatgacaccagaaattgaccttgctaatcaactttgttttagcatatacaatgccaatcggttatttaacaaattttatgtcgaagcgttaacaccattcaaactgacttacgcacagtatctcgtactaatggcattgtgggaacacgacgaccagtcattacacgagttaggtcaggttctgcgcttaagcagcaacaccttgacaccgcttttgcgacgcatggaagacgcagggtggttgcagcgcgagcgaccggcaacagatcggcgccagttactcattcatctcacgacgcagggtaagcaacaacaagcaccaatcgaagccgcgattgcaacttgtatcagtcgctaccacctgactgtcgatgaatatcaacaagcactggccctgaaccagaagattattaccgcattatcacaggatttggcctaaacgggcctttttattgaccgtttcaatcgcgtacgactgaaatataattttaggaggaatctctaatggcagattatgacacaatttttatcggtagcgggcacgcaacgtggcatgcggcagtggccctagcacatgcgcaacataaggtagcaatcattgaagaagataccatcgccgggacgtgcactaactttggctgtgatgctaagattctgttagacggtcccttcgagctgactgaacaactcaaacaatatcaagggattggcgtcaacacaacgcccaccatcgattggtcacagttgatggcctataagcaacaagtcattcaacctttatcggtacaaatgacggccgtcttcaaacaattggggattacaattattaccggtcatggtgagctgactgatacccacactgttcaagtagcggacagcacgtatacagcggataccatcgtcatcgggaccggacaacgaccagccaagctggctatcccgggtgcggacctgatgcatgacagtcgtgattttcttgacctaccaaccatgcctaaacggttgaccttaattggtgctggaatcatctcgctggaatttgccaacatggccgtgttactagggtcagaagtgcatattattgagtttgccgatcgagcactacccgcattttattcagaacacgttaaaaagatgatcacacatctacaggcagccggggtgcacttccactttggcgaagcgcttagccaagtgactaaaacggccacagggttaatggcaaccactgccagcggcctgaagattgagagtgatgatatcattgcggccactggtcggattccaaacatcgaacacttaggactaacgaaagttggcattaagaccgaccggcacggcattatcgtcaacgaccatttgcggacaagcattccaaacatttacgccagtggtgatgtcattagtaagactttgccgaagctaaccccgaccgcgatctttgaatctaactacattgccggccaactgcttggtagcactgccgccattgattatccggtcattccagcggtcgtctttacgctaccaagaatcgcccaagtcggtgtcagtgtcgaggctgcccagcatgatactgaacactttcacgttcaagcgctgccatatggtaaactgttagcctttcagtatcaaaacgaggtcgacgctgatttacaattagtctttgaccaagagaattacctcgtcggtgcctcaatctatggtaatggcgcaccagacctgattaacttactgaccatgattattgctgatcacgtctccgccacaacgttaagtcagaagatttttgcctttccaagtgcttcagtggggatcattgatatgttgacaccactactacaccatgactagttattaaaccaactaactaatttaaagatactgggtatgttgctgactacccagtatctttttgtcgtttcagattaactcactgactgaggacacctaataatttagcgagcaggaccatggcgccaccgagtgaccaaagaaagataccccagcttagccagctagcttgaacaaacaggctgatcagaataaaccaattcattccaaatagccaccagccgagcgtccttttcaaaatcgttgaccaagtatagggtgccgcataccgatttagcggcttaagcgcgattaataaggccggaataagcgcactctcaagcatcgccaaataatggtgcggatcactcgtataagcgattgctcccagcagaccatagcgactcggaatcgtcgttaatagggcccgttgcgcggtgtaaatgacgatcggttgtccaatcaataatgcgagtaatccccaagttgcttttttcatcaatctccgccgtccttattagttaataatactatcctaccaatttatgtacggcactaactaccgaataagtgtaaatttctcgtgaaaaagacgtaaagaataggcatgattcgttcactatgttttcataacataaataataggcattttaaaaaagtatgcgtataataccttcttaataagtttcgatgggggagttatgatgataataatcagagttgcaattatgatttcagttgttttttacttgtattttattattaacttattgttgatcaatcactatcgggagcccattcaaagctatgaaaaagggcccacaccctatgaattatttttggtcattccggtgctcaatgaagaacacgtgatctcgcgcacgattacgcaacttactgaatcactcgaacaattaccaccaaccgttcacgcccagatcattgccgtcgatgacgattcgactgatcacagtctactgttgttaactcagtcatcgtcgcgcttcttacaaatcctacaccgcacgggcaaccagcgtgcaggtaagggggccgtcctcaacactgccgtccagtatattcataagacgttagcgctaaaatctgatccgcaacggacgatcgtgggggtcctagatgcggacgcattcatgaatactgctgatttgacgcgggtactggcgcactttgaacaagaaccacagttggccatgattcaaacgagcgtgaatatctacaatcagcccaactggctgactaagatgcagaattttgaattcatgggggttaataatgctacccaacagttacgcaatcgccttggtcagggaattgcgtcaggtaatggtcagttcgtccggctagatttagcgttacagaatccgtgggggaatagcttacttgaagatctcgaattcactttgcggacctggctgctaggtggtacgcgaacggcctttgatcataccttggttgtccagcaagaggccgttgaacaactacgcccattttttcgtcaacgggtacgctggtgtcagggtgccgttcaatgcatgcgttatctaccagcactttggcgttcgggacgtctgaaccattttcaaaaattggacacgaccttttggattttgatgcctatcagtggttgtatcgtgccactgaccagtctaatcacgttagtcgtgcttgtgagccgtagcctacaacattggcaagttgggtggcatcacttggctatcgggacattactggtgattgctttttcggcttgcttggtattagcagcactgtatcaacgcaactgtgccgtcgtgaaacaacccgttggcttcttagatgctctcaagcagagtttgacctttcaagcattcctattgatcattagcctgacgccatacgtcgccatttaccgacagttacgtggtcaaacggggtgggccaaaacgcaccatggtgttacgacccgcgttgcaaaatatccagatactggcttaaaacgctcatattgagatgaaggtgcatgccgatgaagtggtgctataagatatttcaaattaccgttctcacgattgcagctgccttactcgggtggatgattgtcgccaactggcaagtcaacctgaaattacacctcgcaatcagtgcttggataggcgctggtttattcgtattgttcattggtgccacgattggccttggcagctggtggttgagccgccaccaaactagctggttagttgcagcactgatggggttagctatcttaaaatttccactagggactgtctgaaaacnnnnnnnnnnttttaagacggaccctagttgcagggttaaagatcgacccgacctcagatttctggaattaccatacactagccgcgtttagtgcccaaggattcacctggacccaactgttacaccatggtatcgttggcaattacgtcgtttttccgcacgctttaaatatcgcgaacggctacagtttagtcgcggcttttggcggggccaacttttttgtcagccaactaatcaatattgggtgtactttagtcgatatggtcttaatttactggctagtcgcacgttggctctcacgacaattaggcatcatggctgccctcattttttactggattccagcttattggctgtacggcacgctcttaaatggtggtgaaccgttctttttcaccagcgtcctactcatgatgtatgcgctgacgcgggcattagttccactcacgacgaccacaatcacggatcgacgactatacctagcgttagcgatcgtgatgactgtcgtggccaatatgctgaggccaatcatgggcgtctggttaattgcactgggtttgatgagtttgtgtgtcctgcttaagtctcaccacctttaccgcgttcaagtacgtcagctcctcatatacattgcggtcgtgttagggctcatgttcacagcgactaatctcgacagctggttatatggctttaaggttgcgccagcccaagttgaaactttatacagcctggctacggggacagatgttaaaagtcacgggacctatagcccggcactacaagctaccgtcagccacgaattacgggtggcgcccacgttgacgcaagcctatccgcgaatcacacgaacgatggcgaggactttgcagactaatctcaaacaaatcaagccacagttggggtcatttgttaatgaaaaaatgcagggctttattcgtgaggattatggctatgattggagcttatataacttaagccatcatcccggtttgcttaaccgccactggttttatttagcccctatattgattacaagtgcgacggtttattggcaggcaatgctggtgattgcgttattcagtgttttaatggggctgggactgctatggcatcaacactatcttaaccactatttgctaatggcagcgcttttgttagacggtttcaccttaagtgctttaccattagaagtacagggccgctatcatattatcttgtacttaccaatccttatgttgatgacttgcgggatcgcggaggccaagctctggcggcgtcaaatcaagcagagttgagtggcagtggccatttcaagatcaatacccaaatgaatcgttagcgttcgaagctcactgaatgaaaattaaactgatgatataaaaaagattattactgacagtagtgactgttacttcagtaataatctttttataatgtttaaaaggggacagatcgtctaatttgtaccatcaaattattgtggctacggtcatagttaatagctggcactgccagtatcgttagcaaataccacggatcaattgactttaatggcccgtaatccccatttactaatgccgattgggcgctcgtcaaggtgccaggacagcccggtgatgaccactaaatgattgattgctcttcgccaacatgtcatggcaacgggtttcaagctagggcgaccgtgcaacttaagcagggcgacagtcagtactatgggcgatggatgacgctgttagtgcggggggtggttcggcgtaattacgcgggctagcaaaatcattgctatgagccgtcatgtcaatccgccaggcttcagccaaaacgtgtgttgcaatggatattgtcgtcaaaaccattgaattgcccaattgatccgataaaactggtgttgaagcggttttagaatgcgttgaaatggaataggcttaagagtagggcgaccgggtgctattttgggccgggtaggggttgtcacaaaaggttgaaatgaaccccaacgacccatttgggcgtaatatcggtttgcgtgatgacattgcgttcgtgacaacttgctgcaaattacacaattttattagccgtggtattgaaagaacccatcaccccggtaaattattcaccaaacttttgatctagcacatgtccaacaaacatatgaggccatggcgaattattgttcgtagtctgcaataattgttgacactaaattgactggcacaatcagcttcaataaatacgcttaattttaggactaatggtctgaaattaacaagttgtcaagccacaattctgactaataatcgcccaaaaacagttgaaagctaggctagttgccgttaattaccggggcttcatacaaccgcagtactcaaggatgccactcacatttatggtgtttagcaagcggcctctaatataaattacggtagactgatgtggttgccgaccagataaattagtattacagactggtctaaattacacatctttaacatttttgaacgtggctgatgattcagttaagcgcgtgattgaacactgtcatgatacggtttttggcgtttccggtccatggcaaatcatgtcttttgaaaaaataaggctgtcgttagcaaaccatcgattcaataaatcggcttgataaacaattacgttctaaaagccagttttaaacccaaggtgcacagcaattcagtcgattgactaacagttatgagcaataacatcattaacacagtcaaaagctatttcatgatgcatggtggccaccttatgaatcataatcatatattcacggtaagtcacatcaatatgattcagtgagttcagtagattttataaaaatgtgccataaattaatttgccactcaaaaattatcgctgtgctagcagtaaacttgatgacaattcacgcgataaaagcggtttgttgtgattatgatggcttatgtgtggattatgggtaaatctagctagggggctttttttacattttctagtttacataatatatattatacaaagtagaattaaaaacaaaattgctcccccacgacctgatttaggtcccctgtggtaattttttgattttaagttagctttctggtgattcagttctcagattgtcattttgtcgcaatcattttgctggctctaactgttcagaatttttcaagacgtccgcttaacttaaattattttttatgattcacaaacatcaacactaaaattagtcgattgaatttcaaccgagcatttttcgttaattcggatcaacttatctgaatcactaaaagttcaaatgttttcagactcctaaatccaattatcactagtttgcatgcacgctcatgatttgctgataactaacatcgattttacggtttatttaagggacaacttcttcaactaataaacgaacacgcgcttagaacgcgtctctcagcatcggtcaaatcgcttgtttttgttgtaaatttatgttttagttaaagtaagaattctaacccagaaaggatgtcctactatcaatgaccgctaaatttccgtatgctaaaagctttctcgcctcattagaaactgctggcaagcaagctagtacgattgagcaatatgaattaaccttggctgactttttcaactatgagcagcatttcaatgagacctttgctaaggatcaattactagcagatttaactgagaatgatattcaagcttacttggcaatgctccgtgaacaacgccaattcaaaacatcgacactgaacaaatgtctgtcgaatctaaacggctactttagctatttattttcacaccgaattattacaactttaccaacctttacaattaaagggcaacccttgaccaatcgtcaacaaacaacgacctggccagagcaattagcggcatggttagcaatggatgatctgcatccatacacccgcttattcttgttactaacgaccaagggttatactgccacggagatgctaaccccagggttttatcagcagttgaatgcaattacctttacagcagtagaacaggcttttctggttaaactacgggcctatttgcagccattacagactcaaagtggtagttcggacctttttttaaagcagcgtcaacgcggaaccgacccacatctcaccctcgcggcattgcataaatacttggcgggtgatagtcaacgtttaggtgtgccattaaagccggttgcattgcgccaggacttcatgctgtggtttctcaatcaacaccggacgaccgaaccgactgagatcatgcaacaactacggttagatgaaaccagcctcgaatattaccaaaacttgctacgacaacgtgatttgcgaactttaaaagccactaaaaccgactaagtgacactgatgggctaactgctacagttagcttttttagttaaagtaactttacgttgttgcacgatctttacatcactttacaaacacgtcacaagcattatgtggaatttgctagttaattaagaaaccttaaaacgcctatacaacgcgcctttttgcagttaaactagttttattgaatttaactaaagtattgaaaggatgatttgatgacattctatcgttggttagaaccgtttattgaacaaaatggtccgttcgcgccagccgcttgttatgcgcactcagattttgattttcctttgactagggactgtctgaaaacnnnnnnnnnnagttttcagacggaccctagtaatgttcatgaattatctgattatattacttacttaaatattcgtgactcagtcaaaaaatcattttattcagcattggacgcgtaccaagcaagttaacaatcataattgaactcaaaaaccaacctactagcccagcgacgattgctgtggttgcaggttggtttattcgtgtttttagccttatttttatcgagatgagactcaaacgatacgaagatcgcaaatctgagccattttcaacgcttaatcaccatctagcttattgccaatgttgcttaataaacgcctcacgaccacccatttcttcgatttgataacggaatggattgcgtcgataaaagtcttggtgctcggcttctgcgggataaaatggcttcgcatcttcaatggttgtcacaatcggctcagcaaacttaccgctagccgcaagtgcatctcttgaagcagttgcagttcgacgttgagcttcactattaacaaaaattaccggtcgataactgtcaccacggtcctgaaattggccagaagcatcggttggatcagtctgacgccagtaaatttcgaccaagtcagcataactgattacatctgggtcaaaagtgattttaaccgcttcagtatgcccagtcgtgtggctggcaacttgttcatacgtcggattagcgacggtaccaccagtgtaacctgaaatgactgacttgatcccgggctgttgatcaaacggtttgaccatgcaccagaaacagccaccagcaaatattgcagtctctgtcatctaaattcctcccgtttattaactcaattatttaaataaactctgatactgaccataaccagccttttcaaggtcggcaactggaatgaacttcagtgctgctgaattaatacaataacgaagcccgccgcgatctcgtggcccatctggaaagacgtgacctaaatgtgagtttgcttgtgtgctagtcacttctgttcgatgcatgccaaacgactcgtcacggtgttcgttaagattagtctgatcgattggtttagtgaaggatggccacccacaacccgcatcatatttgtcacgcgagctaaagagtgcttgaccactaactacatcaacgtaaataccttcctggtaaaagttatcatactcaccgctaaatggccgttcggtcgctgcctcttgagtaacggcgtattgttcaggcgttagacgctgtcgtaattcaccttgctgtttatccattactatcagtccttccataattgagttgtgtacaatctaattacagtatttatcataccccaatctagctagaatgcaaaaaagaagctccaacaagtggtagcttctttttaaattaatctgtaaattaagcgttgaaggcgtccgttaattgagggacaacttgcttcttacgtgaaacgacacctggtaagcttaaccggttgttagcaatcgtcttaccaaaggctttttcaacaggttccgttgggttaccaacgactaataattccgagttactatctaagatattagtagccaagattaagaataaatcatagccgtcactcgcattttcgtcttttgcagcagattctaaagcagcttgacgcttgaaaacatcatccaagtcaactgtattgatttgcgcaacgcgcacggtcttgccagccatttcaaatgacttcgcatcggcatcgattaattccttttcagtcttgctgtcaaggttagtgcccgctttaagcattgctaaaccatacgtttcataatcaatatcagcaattttagctaagtctttaacaactgccacgtcagtttccgttgtggttggggactttaagagtaatgtatctgaaatgattgcagataacattaatccagctaacttggctggaatttcaatgtcattttctttgaacaacttgtaaatgacagtgctgcagcaaccaagtggttcagcccggtagaataatggttgggccgtgtcaaaaccagcaattcgatgatgatcaaccacgtgactaacagttacgtcagcaatgtcactcacactttgttgaggttcgttatgatcaacaagcataacactgtcaacttcatcactggccttagtaatcacccgtagtgctggttcatcgaagtaatccaaaacaaattgagtttcttcgttgggttcacctaatgcaactgcttcagtgtccgctcccatcttattttcgtagtatgagaacgccttagccgccacgattgcgtcggtatcaggattttgatgtccaaaaactaattccttactcattagcacaaaactcccttaaaacttatttttgattaatcttttgtaaccgtgaaatataatcttcggtccgtaagtaggcatcaaattcatcaaggaaattcttgattcgcggaatttggtccttatctttacggaagacaaaatttaagtcaaacttgatggctggttcaaatgacaacgtgtggagcttatcagttgccggattagccaccataaatgaatttggcaacgccgtgttagtattagttgctgccacaaagcgataaatctgttgtggcgtcgtaaaccgtgcgactgccgttggcaaatcagccaactggttcttataagattccttaaccacttgatccaagtaatagttttcaggatacgttacccatggattgagcgtcgtatctttgaacttgatgtgcttcttcttcgctaacttctcgtcacccgaaatgaatagcaattcgtcttggataatcttcttagactggtatggcttccagttcttgatactttcatcaggtaggtacatgactgccaaatcaatccgattattttctaatcgttcccaaatctctttacgcgtcagcatgtgcaacgaaataataacatttggattggcctcgtaatacttaatggcaaaattctcaaatacatggtcttcaattgaagctagcacgccaatattgattgttccttgagtagcactagttgtctgctggatttcatcagttgccttgttcaatacactataaatactgtgggttgcgttaagcattgtgtaaccggcgtcagagagacgtaactttttcccaacggaataaaataaaggggcaccaacggtacgctctagttttttgatctgttgggtcaatgctggttgcgtaattcctaaaatttgagctgcctgtgtgtaattcatagtttcagctagttgcaagaaatacgttaacgttttcgatgagaaaatactttcttgagttgtcttcatgaattttacctgatcctttcttcttatcgccatcttatgatatctataattttatacaagattcaaagtgaaagcaagcggttgttattggtaaataaagcttaactaattcataatcttttaccctgttataatattatcttaatcgaatgcccgttaacgtgcaagtattcgcattggaaactataccgttagtgggatcggatggatctgcatagaaacaggttccccttcagtatcagtatcaactacaaaagagccattagaataacgcgcactagtaggatgatcatcattcaagatcgaatggtgcttaccacgatcagtcagcacatcaagtgcaaccccatttgcgtcactagcaactaagacataatcagcgacccggtgtggattattttttaactcccgtaagacttgaacgccccgccgtgcacgacttgtcacgggtaaatctgccaccttcatcttcttgaatgaaccccgttgcgtaatcatggcaatcaaatcatcatctgcggcgattgttgcccgtacaatggcatcgtcgcgcagatccatagatttcacgccgaccgccttcgcaccaatcgttgggacctcgcttaaatcatagcgaaggccatacccatgttgcgttatcagaatcagggttcccgttggtgcagctggtaagtattcgactgttacaacggttgcatcgtctgacttcattttgatgaactggctggcccgagtcttataagttcgacccggcgtgtaatcagcaaaggccgtttgtttgatatagccgtcactagttgccactaagaattttccggtagctttaaggttctcaaaagaatagacccacgtgatgcgctcgttttcagccagcccaatcgtctgagaaatgtgctcaccggtatctttccatttggcgtcagcaatttcataaatcggccggtaaatgagatggcccatgttggtgaacatcattaaatgatctaacgtgctatttttagctagatagattggataatcctcatctttaagcccgttatcatcaggctcagacgctgaataagagcgtaagctggttcgcttgatatagccatcatggctaatcatgacaatgacgtcttcttgtggaatcacgacctcggtcttgacctttaattcttgaatttcattttgaatctcagtcaaacggctcgttggataggctttttgaacggcctttagttcgcgccgtaaaactttatcgagttctttaggctctgccagaatcagctgataggttgcgatagccttggccagttcagctgattctttttctagctgcgtcacatcggtattggttaaccgataaagttgcattgtcacaatggcttcagcttgaatctcagagaaatcgaattgactgaccaagttctgtttggcgttcttcttatccttgctaccacgaatcgttttaattacttggtcgaggatggacatcgccttgattaatccttgaacgatgtgttggcgatccatggccttctgtaagttaaattgggtccgacgggttacaacgtcccgttgatgttccaagtaggccgttagaatcgttttcaggccaacgtgttcgggccgttgatgataaatggcgaccatattgaagttataagtaatttgtagatcggtatttttgagtaagtaagtcagaataccttctgcattgacgtcacgcttcagttcaatcaccactgataatccctgacggtcactttcatcacgaacttcggcgataccttcgatcttcttcagaatgcgaatttcatcaatttttttcaccaattgcgccttgttaacttcataagggatctctgaaacttcaatctgtgatttattccccttaagcggtacgatcttggttcgcgaacgcacgacgatacgcccacggccagtttcataggcttgcttgatacctgctaagccttgaatgatccccccagttggaaaatcggggcccttgacaaagtccatcaaatcttcaagcgttgccttagggtgattcatcaggaataaaatcgcatcaatgacttcactcaagttatgcggcggaatttccgttgcataaccggctgaaatccccgttgccccgttaactaataagttcggaaagcgggccggtaaaacagttggttcgtactctgtatcatcaaaatttaggaccatatcgacagtctttttatcaatgtcttgaagcatttcaccagcgattttactcaaacgcgcctcggtataccgcatggcggcagccggatcaccgtccatggaaccattattcccgtgcatttcaatcagcggttcccgtaacttccagtcctgactaagacgaaccattgcttcataaatcgaagaatcaccatggggatgaaaattacccatgacgtttccgactgatttagcggacttacggaacgctttgtcaaaggtgttgccatcctgattcatggcgtataagattcgtcgttgtactggcttcaagccatcacggatgtctggcaaggcccgttcttgaataatatatttagaataacggccgaagcggtcgcccatgacgtcttcaagggttagttcttgaatttttggttgttcagttgccattttacgaccccctctattgttttagctgttgcgccaattcttcgtcggcttgctcatgtgcggatgagacggcctcgttatctagtaacgacccgtcttcgtccaaattaaagtggacgttactttcgatccattttcgacgaggttcaactttgtcacccattaacgttgtgacccgtttttctgctaaggcagcgtcatcgattcgaactcggactaaggtccgtttttcaggatccatggttgtttcccatagctgttccgcgttcatttcgccaagtcccttgtagcgctggagtgcatagcccttaccgaatgacttggtcttgagcgttaactcttcgtcagtccatgcatattccgtccgtaactgcttgttctgcttcttttgtaatcgatacagcggtggcaacgcaatgtagatcttaccagcgtcaatcattggccgcatgtacttataaaagaatgtcagtaagagaatttgaatatgggcaccatcggtatcggcatcggtcataataatgatcttgtcataattactggccttaatatcaaattcaggaccaacacccgcaccaattgtataaatcatggtattaatttcttcattcttgacaatatcagctaatttggccttttcggtattcaacaccttaccacgtaatggcaaaattgcttggaactttcgatcacgcccctgtttagctgaaccaccggccgaatccccttcgactaagaataattcattcttcttagcgtttttagactgcgctggcgttaattttccagaaagtaaccgttcctgcttatggcgccgcttaccgtttcggctttcatcacgggccttacgggcagcctcacgagcctgccgagctttggtggatttgcgaatcagcatttgagcaaattcaccattttccatcaagaagaattgaagttgttcactcacaatattatcaacaatcgttcgtgcttcgggtgttccgagcttttccttagtttgaccttcaaattgtaagagattttccggtactcgtaatgaaataacagcggataacccttcacggacatcggagccttccaaatttttatccttgtccttcaataggccaaccttgcgagcatattcattgaatgctttcgtccaggcactgcggaaccctacttcatgagtcccaccgtctggcgtccgcacgttattgacgaatgacaacaagttttccgaatagccatcgttgtactgcgcagcgacctcaacttcgacaccttccttagtgccgtcaaagaacataatatccccgagggtgtccttatcttcattgaggtaactgacaaacgccttgataccatcttcgtaatggaagaccagctcttgttgttgattttcccgttcgtcagtcagcgtgattttgacgcctttcagtaagaatgcggattcacgcaaccgttcagccaacgtttgaaaattataaaccgtcgttgtaaagatactagcgtccggcttaaaagtcattgtcgttccagttggcttattagtcttccctttcttttcaagggtaccgacgggatgacccccatctttgaaatgttcaacgtagcggtagccatcacggacaatggttaccgtcaattcggacgacaatgcgttaacgacgctcgcaccgaccccatgcagcccaccagaagtcttataaccaccctggccgaacttaccaccagcatgcaaaaccgtgaggataacttcaggtgttggaataccagaagcatgcattccaactggcatcccacgaccatgatcgacaacggtgatgctgttatcggcgtgaataatcacgttgatttctttaccatagccagctaaggcttcatcaacagcattatcgacaatttcataaactaagtgatggagtccgcggccgtccgtagaaccgatatacattccgggacgtttccgaacggcttctaatccttcaagtacttggattgaagaatcatcatattttgggcttttcttggccattctcacaactccttttatctttaaaaatctacctcaactaggtgcggctttcaggtaaccgtaataaaatagtcctaaaagccccaacctgtcaaggtacaattatgttaatttctaattgtcacttgtggctcttcatctgttagcatacacgttaacaattaaaatagcaaacacacgttcgcgttaaaagctatcttttaaaaattaagccacttactagcttacctcatgttgattctaagcgccagttcaatgaataaacttattactggtcacgactagttcttaaaatgcgtgattaatttgacagttagcgctttaaaggccctaaccacccgctttcaggcacataataattatcaaaaaatcattttattttcataatttgacacgcaatcatcattttttaaaccaattaatccccacaatcttaaaaagaatgctaaaatattgagtgattctattgcaggaggaaccaactttgaaaataataattatgctgatcatcgcctacttaattggcgcgattccttcgggtgtcattattggcaagtttttctttcacactgatattcgtcaagcaggtagcggtaatatcggaactaccaacacgtaccgggtcctaggcccgaccgctgggacaattgtcatggtgatggatattctaaagggcaccatcgcagcactacaaccgaccttgctatttcatatgaataaccggtataccttattgattggactagcagctattttaggacatactttctcaatttacattggctttaaaggtggtaaggccgttgccacgagtgccgggatcttattggcctacaactgggagttcttcttaattgctagtgccatcatgttattgttggtttacacgaccagtatggtcagtgttgctagtatgacggcttttccaatcgtcacgttgattgcaattttttactatcaggattggttgctatcactcgtggcctttgcattgaccctcttcatcttctatcggcaccgcagtaatattgcacgtatcaaaaacgggaccgaatcattggtacacttcggacttggttggcgacgtcagcaacgggctaaccgcaaataattatgttactttcaagaccatttcattactgagtggtctttttatttaggaacgggtaagctttggtgctgggtttgtatttttttgtttctagttaaagtaagatgatacaattctttattttgctatcttttcagaccacaataaaaaccggtcaaacctgtcgaccggtttcactaaaccacagtattttagttagaaaaagctaatcgcatatttagcatcaaacgtctggttcgctgcaagccggttaatgcccatcttatggcttaattgaccgtcgctatcaacgttatccgcaatgccccaccatggctctaagcacacgaacggcgcttctgcggggtatggtgaccacatgccgacgtatggtgcatcttcaatcgtcatcgctaccccatgatcatccagatcagtgtccaacattaacgtcgtctcgtgatgattcaaatccaaaatcagggcatcgtccttaaacaaatcccggctaagtgctaatggcttggtcaggtcgaagtcatccgcatttgacgcatcgttcaacggtgcctgtaatggaatatgcgcgtagacctttcgtggtgccacagtaaccttataatcagctagtgtgcccgccggatcagcgagtggtacgttaaatgctgggtgcccaccaacagaaaataacagctcttgattagctggattatgcacattgtagttaacggtcaattcatgatccgtcaacgtataaatcaaacgtaatcgaaacgcgtacggatacatctcccgcgtcgcacgactatcggtcaattcaaatgttgcttgtgtggccgtttggttgacgaccgtaaagtcattgtcgcgggcaaaaccgtgttgtcccatgtgataagcctgaccagcaacagtatactggtcatcctttaaacgaccaacgattggaaaaagcacgggtgcgtgccggccccaaaaagttttgtcggcctgccacatgtactcaataccgtcactcgacttgacactacttaattccgccccagcttcattaatcaaaacggtgaggtactcattctttaattcgactgtcatccgcgtaaacgcccccttgataaattttataagatgtaacgactaagatccttatcctgtgcaatgttaccgattcgctcgttgacatagctttcagtgattgtgacttcgcccatttccatgtcaggaccttcgtatagcaattcttccaagagcttttccaaaatggtgtgcaaacgacgggcaccgatattttgtgtctcatggttgaccttataggcaatcgtggcaatcgcttcgatagcttcaatcgtgaacgtcactttaatgttgtccgtaccgatcaaggcgatatactgcttaatcaacgcattcttaggttccgtcaaaatcttaacaaagtcatccttgcttaaatcgtctaattcgactcgaattggaaaacggccttgcaattcagcaatcagatcactaggtttactttccgcaaaggccccggaagcgataaacagaatgtgatcagtattgatgggaccatattttgttgaaatttgcgacccctcaacgattggcagaatatctcgttgaaccccttcacgtgaaacttcaccggaaccttgctgaccacccttagtaatcttatcaatttcatcgataaaaataatcccggtattttcagcacggacaatcgcatcatgataaatatcagcgttattgactaacttttcggattcttcccggactaaaatttctcgggcctctgagactggcattgtccgttggatccgcttcttgggcattaaggcacctaaactatcaccaagatcaatacccatttgaccaagcatgttattattacccgcggcggcttgctgggggtcatccatctcgatggtaacctctgagttttctaagcgccccgttttcaactgatcggcaactgataatcgttgattacgaacttcatcggtcacttcttcgttacttgaatcgtcaacgttgggggtctggccgttttgcatctggctaaacatgttcatcatgttttggaactcgttaccattgttcttagcctgcttcttttgggctggtactaataatttgacgagccgtttgtcagcagcctgcaccgcttgtgcccgcacaccagaataagcctgttgttttcccatctcgatagccacgtccactaagtcacgaaccatggattcaacatcgcgaccaacatagccgacttccgtaaacttagttgcttcaaccttcacaaacggggcgtgcacaatcttagccaaccgccgggcaatttcggtcttcccgaccccggttggtccgatcatcagcatatttttgggggtaatttcttcctgcatttcagcagaaagttccatccgccgataacgattacgtagcgcgatcgccaccgcttttttagcttggttttgaccaataacataattatcaagcgcggccacaatttgtttcggtgtcttattgatttcttccatgagcgtttcctcctacattacaacgtttctgagatcacattatgattggtaaagatatcaatgtcgccggcaatatggattgccgcttcagcgacttccttggcactcatatccttagcatgtagctgcattgcgcgagctgcggctaaggcaaagttaccaccagaaccaatggctaagacgtcgttatccggcgtgattacttcaccactcccagaaacaagtaacatgtcatctttgttcatgacgatcaacaaagcttccaatttctgtaacgcctggtcactgcgccattcctgggcaagctcaacggctgcccgttgtaaattcccagaaaattcgttgagtttcttttcaaaacgatcttcaaggttaaacgcatccgcgacactcccggcaaaacctacgacgacctgatcattataaatccgccgaactttatgggctgtccctttcattacgactttttcacccatcgtgacctgaccatcaccggccatggcgttatggccgttttggcgaacggcgcaaatggtagttgcttcaaatttcgttgtcatgttcagtctcctttgtcgattcccgcgttgcccgtgggaaaaattgacgataatcttgttgtaaatgttcctttgtcacgtgcgcataaatttgcgtcgttgacaaacttgtatgacctaacagctcctgcacggtccgtaaatcggcaccattattcagcatctgcgttgcaaacgtgtgccggagcatgtggggatgaatatcagccgttaaactacttttcttaacgatttgattcaagacatattcgattccgccgccagtaatggggccgccgtgacgattaataaacaccgtttggtgcgtttgaccatacttggccatcacgggctgccggcagacggtttcgtaatgctgaagcgcggtagccgcgtaccgaccaaatgggacgtaacgttccttgtcgcccttcccacgaatcaacatcatttttaggtcgtaatcaacgtcggctaattgtagatcgacacactcactcagccgaatcccagtaccatacaggacttctaataacgccgcgttccgggcccccatcacgctatcatccgcatagacggtttgaaataatacgtccagctccttttgatagaaaaaacggggtaagcgcgccgcgtgttttttgagttggacgtacacgaagggattcaatttagctaaatcattcttaaccaaaaagttatagaacgaccgcaagcttgaaactttccgagcaattgaattgcgggtcaagtgccggtcatataaatgacttaaatagacgttaacgtccaaccggtcaacttcagtatacgctttcgcgccgccatttgccgttaagaaatcattaaaagcttgaatgtcttcccgataagcagcagcggtctcttccgaatactgtcgttcaacccgaatgtactttaaaaagatggttaaataatccgtttccatgcaaaaacctccatacgttgctactttagcaaagtatggaggaaaacacaattatgcaccctgtcaatggggcgatattttagttgttaacggtcaatgtttcatctttaaaagtcgtcaggtcagccaaggcccgttcagaaatcgccgtattacgctcacgcttatcccgaatgcgctgtttgagttttggcataatgccaaagttggcgttcatgggctggaagttgctagcgctcgtatgcgtgatatagtgggccatcgcccccatcatcgtgtccgttggaaaaacgaccggttctaaaccaagtgctaagcgcgctgcgttggttccagcaacgatgccactcgctgcactttcaatatagccttcgacgcccgtcatttggcccgcaaaaaacaaatcgggccgttgctgtgtctgataagttggcgttaataatttcggtgacttcataaaagtattacgatgcatgacgccataacggacaaattcaacgttctccagacccggaatcagtgaaaagacccgtttttgttcgccccacttaagatgagtttggaagccgacaatattatatagatcaccagcggcatcatcttggcgcaactgaacgaccgcaaagggttgtttgcccgtcttcggatcttcaaggcccactggtttaagtgggccaaatagcatcgtttggcgcccacgttgtgccatcacttcgatcggcatgcagccttcaaagacatctgaattttcaaaatcatgcgcttcggccatttcggcgtgaatcaacgcgtcatagaaaacgtcaaattcggcttccgtcattgggcagttcagataggccgcttcaccacggtcatagcgtgatttgagatacaccttatccatgtcgatcgaatctttcgttagaatcggtgcggccgcatcaaaaaagtgtaagtcatcttcgtcgttaaacgcttgaatcgatttcgctaaggacgccgccgttaatggtccagtcgctacgaccgtaatgccatctgggagactagtaatttcttcattaataatttcaacattaggtaacgcggtgattgcagccgtgatttctgcagagaacgtatcccgatcaacggctagcgcaccaccagctgggacagcgtggtgttcagccgcttgcatcacgatcgaatccatctgccgcatttcggcctttagtaggcccgccgcgttggctaattggttcgcccgcagtgagttcgtgcacactaattcagcaaattgcgccgtgtgatgggcgggagtcattttgttgggccgcatttcatacagccggacattgacgcccatattagcaatatgccaagcggcctctgagccggctaaaccggcgccaattacgtttactgttggtattgatgccatccagaattcctcttttcttgttgtcataccattgatagtattgttgtcatcatacctgagaaactagcagaagacaactaatggcatcagcaaatcctgcaatgacatgtccaccgtcaagcttaaagcgaacattaatttaaacgggcgtttattttcccgataaaacacttgttaatcagtttaaattacgaattttatcaacgtattttcaaaaattgtacgcattatttgacaatacacaaaaaaagatcatccctagatgacctttttttcatttatttttgaacgttttcggtataatcgccattcggacaaagcacttgcttgccacctttgaccttcttttcgaccaggtaatggccatccttcgggcaatcacggccaaccggtttatcccaagagacaaagtcacaatctgggaagcgggaacaaccataaaaaatccggttcttcttcgatttccgctcaatgacctggcccttcttacattgcggacaaacgacaccaatttctttaacgatcggcttcgtattacgacaatccgggaaacgggagcaggcaaagaatttgccgtaacggcccatcttcacaaccattggcgcgccacaaatatcacaattgaagcccgctaattcgtctttgatttggatcttctccatactttcctcagccgttgcgacttctttagaaaacggcttgtagaaactatcgacgactttaacccagttttccttaccttcttcagtcgcatccaactgttcttctaaactggcagtaaagccgacattaacgacatccgggaagtattcctgaataatatcgttaacgatctcgccgagttcagtcggcacaaaccggcgcgcttctaatttgacgtagtagcgccgctgaatcgtatccagggttggtgcgtacgttgacggccgccccacaccattttcttccaatgctttgatgaggttggcttcagagtaacgtgcgggtggctgggtgaagtgttgttgcggatcagtcttcgataacttgaccacatcaccttcacttaaatctggtaagacgttattcttttccgtcttatcgtagatcttcgtaaaaccagcaaacttcgtcttcgacccgttcgcccggaattggacgtcattttggtcgatcgtgaccgccattgtgtcaagtacttcgggcgtcatctgactagccacaaaccgtgaccagatcagctggtataaccggaattgatccttcgtcaagtagtctttgatgctagctggtgtccggaagacggatgagggtcggattgcttcatgggcatcctgagcgccttctggtaacttgcccttgacaggtttggtggccgcatattctgcgccgtattctttatgcaagaattgtgacgcttcgtgcttcgcaatcgacgaaatccgcgtcgagtcagtccgcatataagtgattaagccgacgctaccttccttaccaccaacattgatgccttcatataattgttgtgctgccatcatggtcttacgcgtccggaaattcaacttccggttggcatcctgttgcatggtagaggttgtaaatggcggcgccgggaaccgtttacgttcttttttgacgactttgacgacattaaaatcgccattccggtctaattggcccaagattttttgcaccgcatcgttgtcatccaacggttgcttcttaccatgggttccataaaaacttgccatgaatttggaacgacccttttgaaattcactatcgatcgtccaatactcttggggtttgaacgctttaatttcattttcacgttgaatgatcaaatctagcgcgatcgattgcacccgaccggccgataacccctttttgacctttttccacaataatggactaattgagtaacccactaaccggtccaaaattcgccgggcctgttgggcatccactaggtccatatcaattgaacgcggttccttaaaagcgtttttgaccgtatccttggtgatttcattgaagacgacccggtttttatccttagggtcaagtcctaataaataggataagtgccaagcaatggcttccccttcacggtccgggtcagatgcgaggtacacggctttggcttttttagcctctttccgcaatcctttgatcacatcacccttaccgcgaatcgagatatagtgcggttcgtagtcgttatccacgtcgacacccatcttgctcttcggtaaatcccgaatatggcccagactagcgacgactttataagaacgacctaaatatttttcaatcgtttttgctttagatggtgattccacgatcaccaattttttagcgggtgttttgcttttccgcttggtagcagttttagttgcggtcttccgctttgccgccggtttggctttagttgtacttgcagccactcgatcagctccttacaggtttcattatcattattataaatatcagtttaagaaatccctgtaatcatatttcaaaaatttcgtgttgtcaaatttttggtaaaaactcttctattatatgtcgcgaatttaagactggtttggcccccgcaacgatcaattgattgcacccaactgaaaatggtgcatcaattggtccaggtaccgccagaacgttgcgattgttttgtaacgcgatattagcagtgatcagactcccagaatgggcctgcgcctcgaccacgataaccgtttggcacagcccggcaataatccggttacgagcaacgaagtggtatggttccggacccacccccagcgggtactcactgattagtaaaccgacctgactaatttgctgctgtaggtcacggtgttgacgggggtaactaatatccagcccggtcccaatcaccccgattgtcggtaagttaaaacgaagggcggtccgatgtgcaaaaccatcggctcccttcgctagtccactgacaatggtcaactttgccgttgctaacggtgccaataattgcgtcgtgacccgttccgcatacgatgtggcctgccgagcaccaacaaccgcaagttgacgtgtcgttagtaacgcacgctgcccgcgcaaaaacaacactaatggtggttgataggcttctaataaggccggtgggtaatcatcatccaagattgttaaaatatcaagctgcgcatggcgttttagtcgctgttgaaacgccatactttgccaatcagcggtaaaacgcccctgctgactagcagttaaatgggccaacttacctaatcggcggggatcagtgacgaccgtctgaacctgccgacagtgttgtaacacgcgtaccatcccggcatacccgatgccgtgcgctaaatgtaatcgaatcaataaacttcttaattgcatgttatcacgactccttaagttcgcccttgttgacattagtcgtcaacggaacggcttctttaaagagtagttacggatttagacccgcttagcatttcgaaccggtgaaaaagattggcgatgaatcggcgtagcgccgagactggccaacccggccaaatgcttagcagtcccgtagcccatattatcagcaaagtcgtacccgggatacacttgatcatacattgtcattaagtgatcccggacgactttggcgacaatactagccgccgagatgctcgcgcttttcgcatcgcccttgattagacgggtctgttcaattggtaccggcacctgcatcgcatcaactagtaaacgggttggccggacggacaggttacggacggcttgggccattgcgactcgggtcgcctcataaatgtttaattgatcaatttgttgggcatccgcaacgccgattcccacggcgaccgcttcttctaggatccgtggcatcagggccgcccgtttcttagcggttaattgctttgaatcattgacttctagcaaatcaaaatgatcgtccaagactacagcggcagttacgactggtccagctaacgggccgcgaccaacttcatcgatcccagcaacgtattgtccgccgtgggcccaaaaatcccgttctaaacgcatatgttgattaaaacgtgtcactaacaccgcctgtttttcagcttgtcgcaaatagtgttgataagcctgttgcacgcccttgcgaggatcggcttgagccgcggctagaagcgatgccgttggttggtcagccagtagccgtttaaaatccgcaatcgttcgttcaggcatcgggttgatcccccgttaagtcgagcgtaaaacgaccgagccggcccttgcgaatatctaagaggaaggccacgcagaaacgttcccagtcatcgcgcatccccgcatttttcgtcatcgcaatcagtaattccggatttggtaaggttaactgctcagccgtcaaatgataacgatcgactaagcgtgccgcgtagtgctgcttgaagaagtccaaggcaaacaaagcgacgtcatcgttaggatagatattttccttaatcgcacccgtgacggccagcttggtaccaacgacttggtcttcaaacttcggccataaaatccctggggtgtcgagtaattccaatttattggacgctttgagccactgttggcccttggtaacgcccggacgatcaccgactttggcaatttttttattgacaatatggtttaataaggtcgatttaccaacgttggggataccgacacaaactgcgcggattggccgattagtaatgccacgggccgcaatttttgctaacttgtcagctaacatgtcactagccgcttgcgtcatttgtttaccaatcgtacggctacgtgaatcgaccgcgatcgcaacttgaccctggtcttcgtaatacttgacccagtcagctgtcgcttggggatctgccaagtccttcttggtcataattaagaggtgtggtttttgttgaaccgttttttcaatttctggattccgggaagccactgggatccgggcgtcgaccaattcaaaaacaatatcaactaaatgtaaattgtcctgaatttgatgaatcgccttggccatgtgacctgggtaccattgaatatttgccattacgttgtgctcctttttctcgtgacgtgaatgccttcaaactttgatcattgttaaaattctttagcagcactggctgtcaagccgatgctgctagctccagtggcgacatgcttaagtgctttacatcaaccgccactaatgcgttgattcaacgaaatcgttggtcgctatgccgcccatgaactaaaacaccggacgcttgctagtccgggactggcatgatgtagcaatctatattttaccatgtttacaccgaccatgctttgaaaccgaccattgatctgctgcccaatacttccgcacgttaatttagctaaccggaacatcgaccccattttattggctgcaagcttgcggtagctgtcaattagctcgttagtccaagcacatcgcataaccgtccttagcgttaacgtccaccgatacgatcatacacacagttcacctactacaaatgcaaataagcgcgacgtcacagccttcatcatcaagatggccgcaacatcgcgcttgtttgatagccgtcagctaactaactgacgtgacttaatcccagaatttagctgcaatcttttgtccctgatcaatctttgcccactgctgagccgccgttaactcgttacctgagtcacacgaagcgaagccgcattgatgagataaatataactggttcttattcaaaatttgactagcttgcgtcagtaaccgtaacgcgcgatcttcatcatctaagatattggtcttactggataacaggcccaagacgacttccacattcggccggtcctcaagtaccttgagcgctgaaagatcaccggcgcggtcatcgtcccattcaaggaagaaacggtcgtagtgttggtcatgcaggaatttcttagcaatcgtattgtaactgccttctgcaaagtgccgactttcataattaccacgacaattatgcgtccaaactttcaaccctaattgatggccaaaatcaactaactcattattggtgttgacggctacatcagctaattcttggagactgccatttccagcaccaaagggactttgctgattatcactggcaaacacttcccacaagcagtcatcgaattggatgattttgccacccgcagcttgataatccgttaagaattctttatacgccccgagtaagcctgcatgcaagtcatcaacagttttgtaaatctggtcagggccatatagcttatcgatgtatccaaactcaacaaaggcgtgtgcgggactccagatcgttaatttaacgtcattaccatcggcttgtgacttaagttgctgataaatatcaataaaatgatgatgcttgccagaaagtggtgctgtgatttcaatgccaatatctttacgtgtttcaaaatcactgccgtcatgatcgcgaaaattataaccttcatccgcaataaaccgccgaacaccactaaacccccaaataaaatccaaatgccacattgacttcgtatattcgccatccgttagcacatcaatcccatgcgccttttcggtggcaatcaccgtcttcactgccgctgtttcggcagcctggtagcccggcaaagcctcataaaatgggtattgaatatcgtcacgatgttcgatttgatttttataagtaagtaaactagccgggcgtaagagtgagccgaccaattggaaatgtgtttttgtcataatgtaatcatcctccgtgtctgtcttaatgagtttattataacaatctgattaaaaaatagataagactgattgcattgatgatataataggcaatacctataacctaaataatttattcaatcacaccagctacaatcatgcgttaattagatactgaaaccagacatttctcaggaggtgcacttaatgcgtattcaacaattgcgctacttagaaaaaattgccacgactggctcgatcaacgaggcggccaaacagttatttatcagccaaccctcattatcccaagcaatgaaagaactcgaaaaggaatatcaagtacagcttttttatcgtcataaaacggggatcactttgacggatgcgggccgtgaattcattaactattctcgcagtgtcctcgaccaagttaatttactcaacgaacattttggtcagggaaccgttcgcaagcgtatctttagtgtctctgcgcaacactatgcgtttgtcgtgaacgcctttgtcgaattagtcaaggaaattggtggcgatacctatcagttcacattacgcgagactgaaacggccaacgtgctcaatgacgttcagactttgaaaagcgaacttggcgtcatttatcttaataagttcaatcagaccgtgcttagccgtttgattgctgacaaagacttaagcttcgtaccgctattcgaggctcgcccgcatgttttcatcggtcgtgataacccattaacgcacaagcaagaactgactttggatgacctacgagactatccctacctctcttatgagcaaggcgatacgagttccttttattttgcagaagaaatcctcagtacgctgcctcataaaaaacatatccgcatcagtgatcgggcaacgatcttcaacttgatggtgggtttaaacggctatacgatcagttcaggcatcatcagcagtgaactcaatgacgaaaaaattgtggcgattccactaaaagtggatgatgcaatgacccttggatacctgcgccataagaaaatcgaattgagcgctacggcccagcgctatttgacactattgaaacagcacattcaaggatatggctttgacgtttttaataataattgactgatcgacacatgacgtgactgaattcattttttgttaacaacatacagtggcgggttgttttttgcaatttgatcaaggctttaatgtccaaaccgcaatcgccttcactaaagcaggacacctaaaccatttaaacatcatatatatcctttttcaaaacccccgctgagtatggattaactcagcggggatatcagtttttttatcttaatttattgatgagatttcaacacactcaaaattcaatcaatcttgttcataataatatgcatttaaagtatatgttttaataggggtaatctgtaattcatatttttcaactaaatcagctaactcctgaccatcaattagtgttaccgtattatttccctgcatcgccttagctttagctcggttagtgaaatgactagttgtcacaaagataccatattcagcattaaaactatccatgacgcccttaaatttatcaatttcaggttcggatacctggtcctgcgtataccgtttgcactgtattgccacccggctagtacgaaactcgtcggatttaaaatagccaaagccatcgataccgtgatcagctgaacgtaccacaccacgatttttatcaatggtcacacccatttttgaaatcaatgctcgcgaaaagttttcaaactttccagaattgaatttttttaaacattcaattaaatcactcttccattgtgattcatctgcatcttgtcgcgactctggatcatcgattacgaccagatcctcatccctatctgccaacttgtcatcagattcctgcattgctgttaatttccgatgtactctttcacgtgtcttttgattccaatagttcgtaactagttgggtttgttcagaggtcggataatttgataattcagcagttctgccgatacttgtcagtgaaatttcctttccccattccatggaactaatatagccaactgtaagtagattttttaacccaaagttgaaatcgtataggaagggattatacgctcttccggtccgtgcactgactttagtatcatagacatcctcatacttcagattaacatattcatttgtagcaattgtctggcgtattatttttcgtgaggctgttccaccaagttcccgtagtgctaaaacgattgccttctctacattccaacgcttataactcatctcaaatgccaactttcaaatttaatgccaactattttttgacacagcaaactgtcaatattcggcttcaaaatttattctatcatgtttgaattagtcttgcgttgtgcgtttccccatctaaccaactaagatcacgaaaaaatacgacattcaggttgaatgccgcattttagtttggtttagctacttgtttgtttcaacatccaatgcatgtttggccgcaagcgcacgaccaaaatcagtttcatcaaaatgatcaatgatttgctgaagcgcggtcgcacttaaactggccccaaataacggactgccgggttcagtcataataccatccgccagtcggggatagctaatgggatcaaacccaagcgtctccacaaagtgggccacagttgctacggcttggggctcatcaccagctaccaatagggccttccgcgccggatcgccattaggtctggcgtcttcttgcagattatgataacccatatggttcagtgttttaaccagatggctccctttgaagtattgctggacttgttcgctggaggacgtctggggatccagaacttcttcccgtaccccgtctgtttcccaccaataattcatagcgtcaattacaagtttgccatcaagcgccgtagccgggatttgccggtaacgactcagcggcaatgctaaaataattaactcactgttggcgatgacatcctgattttccgccgcaattgcacccggaactagtgtttgaatcgttagttcaattttgcttactttgccagagcccgaaatgcgaacgtcatacccggccgccaatgccagttccgctaagacgataccaactttaccggcgccgaggattccaacgtttttgactgtcatttggtcgtcacctgcttcgcttgtaaaatagttttaacttgtggaatcacctgtgtcgcatacaattcaatcatccgttcacgttgagccgccgtttgattaccggccccgtataccaagtcaaagcgccccagccctagtgtttcaatcgtcgtcgcgatccgttgcgcaaccacggtcggcgtcccaacataaaacgacccgtattttgtttcacgttcaaattgttcgtgactcattggcgcccatccccgggtcaatccaatgcgatcaaaattagctttgatattttgataagccaccgtcaaggcctcatcctgatcatccgcaatgaatccatgcgaatgcaccgcaatcggataagctggctgattgaactttttagcggcttcgtgatacagtttgatatacggtttaaatcggtccgcccggccaccgatgattgcaatgatgactttatagccaatcttagccgcgcgaataattgattctggtgaaccaccaatcccaatgtaagtctcaagttcaccagtagctgtctttggatacacgtcttgattcgttaacgaagcccgaaacttacccgaccaagtcaccggcttttccgttcgcaattggtcatatagtgcgagtttttcgttaaataggtcatcataatccgtcaaatcatagccaaataacgggaacgattcggtaaacgacccccgtcctaacatcacttgggcgcgcccattagacagaccgtctaacgttgcaaaccgttcataaactcgaaccgggtcatcggaactcagcaccgttactgctgacgctaatttgatgtgctgggtcacggcagcggtggctgctaacaccgtttccggacttgagacactgtagtctggtcggtgatgttcaccaatgccaaaaacatccagcccatactgatccgctaactgaccttcgcgcacgatttggcgcaatgactctcccgtcgactgtaaactaccatccgcgttcgccacaatatccccaaatgtttctaacccaaattctagttgattaacatcaatcatcttaatgcccccattacttttattttacttacttttagtaagttattgatgttaatatatcgtattatctctttaaatgcaactgatagacacagcttgatagtcccttcaatcatgattaaaacaatctgccaattagatgaattccggttcggtagtaattcagcgatacaggcatcgcacagaataaaaagaggtattcaattagaatacctctccgtaactcatctgtaagttgttccgaaccaatcatcattgcaaaaatcaagtttacacacgctatctagccctgggcctgccgttgcgtctcatgacgttgtgcccataagttgatcactaaagcgacaatcattaatccgaacgcaacaatcatgatattttgtagtccggtgtgtaagatgccacgcatcatcggcactaggtgcgctggtagtcggcccgcccgactagcatcacttaactggttcatcatcgccatggtgattttaccatccgatcgtgccaccccactagtcagagcttggttcatgattagcccaaagatagccgtggtaaacgtctggctgagcatccgaatcaaataactaaacgaagtcgcaactggaatgtcacgttgatcagcgtctacttggaccttaacctgcagctcattaaagcaggccccattgccccaaccttcaaagaagccagctaagagtaagacccagtatggaagcttaacaccgccaatcatcaatggaacgaaggtcagcgtcaaaatgataatattgatcgtcaagacgcgatggggcgtcaagtgccgccgcatgcggggaactgattcactacccccaaaattagcaaaagcacttggaatctgcgtggctcccccaattaacgctgacgtccctagcaagccctgagcccacatcggactgtacgtcaaaaaggcaacgaacgcgccccaaataagcacaaataagacgaaatcgaccactaacggcgcgttcttaaacaggcggcccggaataaccgggtccacagcgcgacgttccacgatggttaaactgcccaacacaatgagcgcccccacgatcacgatcgcgacaatccataacgacaccatgccgatcagttcaataccaccaagcaaactgatgatcccaaccgccatcaataacgcccctgcacgatccattggttgcaagttatgttcccgcttaggttcttgatagaagatttgtaacagcacggctgagacaatcccaattggtacgttgaggtaaaagatccagtgccaagaccacacatcgacaatcacaccaccgaccatggggccaataatcgttgccatactaaagcaagccgagactagtcccagtgcccgcattcgatcacgcggattcttaaaaatgtccgcatacatgatgtaaggtaaggaaatcatccccccgttgccgagacccgcaacaccccgagcaataatcaaaaaccagatgttgggtgctaatccttgtagtaaggagccgacaataaagagtgccgtcgtcatttgataagctcgcttattaccaaagcgctcacccatttttgaccagatcaaggtcgaaactgccgttcctagtaagaaaacagcgacgatccacgccattaaccgtagaccgtgtaaatccgcaataattgctggtagcgccgtattcacattcgtactatcgataccagccataacgttcgatagtaacagggcgccctgaacaaaataaatggcccgtcgattcacaacaaaacttctttctataattgctaaacatctcgccagtcgttcagctaaaagttacctcaatgcaacccgttgaaattcactatttcatactgatcaattaacgcacaatttctagtataccgctttacccccaccgcaaggcaagtctaaatcttgatttaaattcatgatgaacaagactttccactgccgatttataaagccacccgtgacaagccatttttgagcctaattcgtagatccacctccatcttgtcaaagcttcgttgacggtaccgcattaaaattccgcaactaaaaaggcataaccgaaagccatgcggatttcggttacgccttttaaaatatacgaatcagctttgaactaatttgtcttttcaatcaatttcattgctgcatcgtaagcccgatcattatcactgatcttattagctaattcagtctcgatcttagtcagtgtctgtttatcgaccttgccattgaccgttaacttggcatgcttttgatactgcttgaccgcactggtggttgaatcaccaaagtagccattaacggttcctttaaagtaacctaaggcttgcaagtacttctggaacgtcttgacattgctattgaccttgtcagcttgtaaatcactgaccttgctaataaccgtcaagcttgcataactcggctcatcagctttaacatcaggtgtcaagcccttcttgttgatccaagtgccgtttggtgtcagccacttcgcgaccgtgatcttcatctcagtcttatcattaaaagtcgtcaccgtttgaacggtccccttaccatatgactgtgacccgaccagtttaacacctgccgattgatgcaaggctgcggagaagatttcagctgccgaagcactcccaccatcaattaagacggtcgttggcttcgtttctttaaagccaccatcatacttcttggacgccgtgtatttttcggtcgaaccatcgcgtgcttggacctgcatgatcgtcttaccattcttcaagaagattgaggccatcttcaaggcagccgtcatcaacccgccaggattaccacgcatatcgatgactaacttcttggcccccttcttatcgagtgccttcaacgccgtcttaaattccttagcagtattcgtcgagaaggtcgataccgtaatataaccgatcttcttatcgccaccgactaacttataatcaacggtcgtcactggaatcttagcccgcttcaaacttacggtaaaggtttgaccactgcgttcaatcgtcaatttgaccgtcgtaccgatcttaccacgcatcatgctaacggcttgtgtcaaggtcttaccggccactgacttgccattgaccgccttaataatgtccttcggtttcaaaccagctttcttagctggcgtaccagcaattggtgaaataatttgaacatagttgccagatttttgaacctgggcaccaattccagaaaacgaactgtcgatcgtgtcattcaagctttccgtctcgctcttgtccatgtactcggaaaatttatcacctaacgaattgaccatgccgttaatggcaccgttggccaacttattcgcattgaccggtttgtagtaattctcattgatcgtttcataaactgattcgatctttttcattgctttactagtctgctgcatactgctgagctgggcattgacttgccgaccaatcagccagtacgtcccacccaccccaatgcctaatgcgacgacaatggaaataatataggtccatagaccaacgcgtcgctttggccggggcactttttttatgtgcggattagtttgtttgggttcctctggcataccgaacgtcctctttcctacaaattaatttaagcttcacttgccaaataggcttgccacgcgtcatcaaagaccgtcatcgttggcaaataaccagcgttcaattccaaatattgtgagagttcgtgaaaatctttactctgctttggaaacgattgatccaaaaacgcattattggcaaattcggcaatggcatcggtactgtctgggttccgttgcgtcatcaagaatgtataaaatgttttatgcatgaattcactccttagtcactagtttttggaatatgcatttcgaacttgaactgattattcttcaaatcaagcttatctacactataacgaacatcatgtttaccaactaatttattcaagtagaggtcgattgtcttcttcttggcattcaacttgacccacttaggtgtcttgtaattattattaatataattaatcacaaagctgattggcaaggacatcgtcccgaccgataaattggttgctttcaacgaaatattgccgttatcgatgacacttggttgcatcgtgatcacaaacgacacgttctgacccagtacctgcgtcgttccgagcaaataagcgccggtagaccggaccacgaagcgatatttcatgtcttggcccttttgtagatcattcaaataataactcgcaagggcgtttaattgttttcgattcattgtaatcggcacactagccgcatccgtattgcttgcagccgtcaaactagtgctttcgctaggcgatcgtaagacctgggtgccgacgtaagcaccggtgccgacaatcaacgcaatcaagacaacggcgacccatttccaaacattgattggaccgtttgtcttcggatttttaggtgctgatgcctgcttgtttcgttgtgcttcccgcatctcattacctccctactttttgattaaccacgcatcatgggccatcatggtctgatacagtttggttgtaaacacacgatacccccgcttattgggatggaaattatcagcagtcgaaatcaaatcattcgtcttgttttccgcctctaaagcgccagtaatggcctttgagctggttaagctagttaaggtcgtggcactcgctgctttcttcaacttgcgaatctgggctgccgtcttgtactggccgtgtgacatggtccaattgatatccataaaatacgtgtgcttgtattgactaaccgtcgtctgtgtctgatcattccactggctaatgtagtgcgtgatcgacgtcacatttggaaagttcacataaattggattatagatgctaaagacaaaaactgacgcagtgccattcaaactttgtaatttattaaataatttagttagtttattcgcatataaagtttgcgctttagcaaccgtcgcgttatttttggccgtattgttagaagttagggacccttcgagcgtttgcaagaggtcgttaccgccaaccgtcacggtaatcacatccgccttggcaattttctgttgtaacactttcgacttattaatgcgtgctaaaatctggtcactccgatcaccggacttaccagcattcgtggtcgtcaccttcagcttttgcttagtcgtcaacgtttttttgatctgaccaacgtagccaccctcggactcatcgccgaccccttcggttaaggagtcaccgaccgcgaccaagttgattttcgccttgtggggcgtcttcttggcagtggtctttttagtcgttgttggggtagtcgtcgccgattcattttgcggatgcagcagataattgaccccgaaaaacaccccgaccgctaacaccgccatcactaaaatgattttgatggtttctttaactttggacattggcatccaacctttcttcaccgttgagcagtccatttaatcagagctaactcatctttgaacaataaaatggtcaccatcccctgttgggacgatcaccatttgccattagtgctcgtagacaagtcgcctgtgggacaccgctcactttacgctggcgcttgcgtatgatattccacggcaaacgcacccgggccaccatgggtcgcaataattggcaccgttggttgaacactgatcttgagacttggtaaagccgcttgtaggcgcgcccgatattcttccacgcgctccgtggcgccaacgtgagagattgcaacttcggcgacgttcggcgttgcaataatatcgtcgagaaccttatcaaaaaacttattaatcgccttaacaccgcgccccttcatcttcacatctagggtgccgtcatcaacttccaaggcaatcttaacattcagtagcgtactgattgcccccgtcagacgactgattcgaccaccagcaacgaggttattcagggtcattacgcccatgaatagcttggtatgggcctgagtcgcatgaatctgatcgatgaccgcctgtttgtcagcaccactctgggctaacttagcagcagtcaaaacttgaaaggccatcgcacggtcggtcgtccgagcgtcgatcacggtgacatcggtcttcgtaatcgaagccgcttgttccgccgtgtgcactgttcctgaaatggcttcgagcatattgatacaaatcacactcgcgccatccgcacctaacttatcaaacgtttcaatgaacgttccgagtgccggttggctcgtctttggtaaagatttagccgttgccatcttgtcaataaattcttcacgcgtaatcgtttcatcttccacgtaaatggtgccatcgatcatgacagtcaacggaatcacggtaatatcgtatttttttacctcggcatccgtcaaatttgccgaagaatcggtcacaatcttgattttcgtcatactttgccacgctttcttatacttgtaacgtttaaacgatcgttacaataaaattaatgctttcagtatagcagaaatctgcctgagtttcacggttgccactgaattaacgacggcggaaatcatcaaattcgtacggatattgatttttctcatccaccgtcccaatttgttggctcaccagctgccactgcgtgtaatccacggccggcatccaagtatcaccatcaaaccttgcgttgatacgcgtccgatataaataatcggccaccggtaacacggcttcaaacaccaccgcaccaccaatgacaaaaatcggttcatccggatgggcagccgcgagtgtttggatcgccgccacatctgctagttgatggacttccggtggcaactttaaatcagactgacgtgagagcacccaattggtccgccgtgggagcgggcgtttaaagcccgcaaaagtcttgcgccccatcacgacatggtgtccggtcgtcagcgctttgaaccgctgcatatctgctggtaaatgccagggaagctggccctggttgccaatcaggccattttgatcttctgcccatatcaatgcaatcattgcggcctcctaaatcgcgaccggcgctttgattgccggtgcgggatcataaccactgagcttgatgtcactcatttggtaatcaaaaatactgtcatgagccccacttaaagtcagctggggtgctggccgaggttgccgggtcaactgcgttttaacttgttccacatggttagtataaatgtgcgcgtcacccaacgtatgcacgaactcgcccactgctaggcccgtctccttagcaatcagatgtgttagtaacgcataactcgcaatattgaatggcacacctaggaagacatcgcctgaacgttggtagagttggcaagagagcttaccatccgcgacatagaattgaaacagagtatgacacggtggtaacgccatgttcggcacatcttctggattccaagcggaaacgattaaccgccgcgaatccggatgcgtcttgatcatttcaatcacattggcaatttgatcgatcgtcttttcctgacgcgtttgccagtgacgccattgcgcaccgtaaacgtcacccaaattaccatacttggccgcaaacgcgtcgtctgtcaagatctggtcatcaaaggtctgcatctgagcttgataaatcggcgcaaagtcaggatcatctagccggcggtgttcaaaattcgtcatatcagggccgtcataatcggcactcgtaacccaatttttgaacgcccattcgtcccagatatggttgtgatgttgcaataaatactgaatattcgtatcaccatgcaaaaaccatagtaattcgctcttgatcagtccaaagggaacttttttggtcgtcaataacgggaagccttgactcaggtcaaagcgcatctggtaaccaaacacactgtatgttcccgtgccggtacggtcatccttatacgtgccgtgttctaaaatggtgcgcgcgagttgtaaataactatcttctaacatgcgatcatcctttcaggcttctgcatactggctgaggtagtcccagcgatccatcttctcatcaatcgtttgttccgtcttagtcaattctttttgcaaatcagccaacttgccataatcactggcattggcagccatcgccgcttcgatctcactcttatggctatccaattgctcgataaccccttcgatcttgtcgtattcgagctgttccgcgtaagtcagcttgactttggctttcttggccaatggtgcggtcgagtcatccgtgaccggcttagccgtagtttttgtcgcagtggccttggctgcgggcttggccgcgtctttttgatccttcaaataactggagaaacggccagaatagcgttcaatatgcccctgaccatcaaaaatcagtagtttcgtgccgaccttgtccaaaaaatagcggtcatgggaaacggtgatgacggtcccggaaaaatcatcaaggtagttctccaacaccgttaacgtaccaatatccaaatcattagtcggttcgtccaataagaggacgttcggctgttgcatcaacaacttcagtaagtataaccggcgctgttcgcccccagataacttgcgaatcagcgtgccgtgcatcgaacgtgggaacagaaactcttctagtaactcagtcactgaaacatgctcgccctgcttattcaagaccgtctcaccgacatcttgcaagtaattaatgatgcgcttgtcgcccggaatcggttcggtctgttgagtataataggccatcttgacggtctcaccgatcgtcacggtcccactatcaagtggcagtcgacccgcaatcacattcaataaactagatttcccggcaccgttgattccagtgataccgatgcggtcattggcttggatcaacatcgaaaagtgatccaggatggtttgccgatcaaactgcaagctcgcgtcctttaactcgatcactttcttacccaaacgctgctgaccgagcgaaatatcaacatcgttatcaacttggagcgtattcaaattatccttcaaatcattgaaccgattgatgcgcccctgttgcttcgtgctacgcgcgggtgctcccgcacgcatccaagccagttcctttttgtacagctgctgttgcttatgttcagctaacacgtcacgggcgacccgttcggctttcgcttgcacgaaatcttggtaatttcccgtatacttatgcagctcgccaaatgacaattcaaacatctggttggcgacttgatccaagaaataccggtcatgggtcacgacaatcaaagcacccttataactagctaaatagctttctaaccactcaattgagtcaaaatcaagatggttggtcggttcgtctagtaataaaagatccggtgattgaatcaacacttgcgccaggcccacccgcttctgttggccccccgacatctgactgacggtctgcgtcaggtcggtaatgtgcagttgtgtcaaaatcgttttgacatcactttcagccgtccaagcatcttcttggttcattcgatcctcagcggccacgtaagctttttgggtcgcttggtcttcgggatgatcagcataagcggccaacgtttgctcgtagtggcgaatcgttcgaaagacttgctgactaccggccaaaacggcatcaatgactgtcagattctggtcaagttccggcttttgctttaaataaccaatcgtataatttttgggcatcaccagttgaccggcttccggtgccgtaatcccggctaatacgtctaataaattcgttttcccggacccgttaacgccaatgacaccaatccggtcatgttcattcacaataaatgaaatatcgtgaaataacgtcttctcaccataagttcgggtcagattttctgctcttaaagtttgcattgttacgatccaccctttttttacatcattaagttctatcttagctagaatcggcttaaaacacaactgacaaacgcgcaaatcaacgttaatatttcctaacgatcatcgattcgattgggtcgtgagtcacaaaaaaactcctgaggctcactcggccccaagagttgtttggcaacaccttattagttatgatcaccataaacatcaaagacggtccgttcatcatcaacgactaagtgtaattttccatcgctggctaatgagctcgtctgataaatgttgtcgataccatccgcatcccgtggcttgaatggcaagtaaatttgttcactaccacgttcgtcgccaaacaggatgtcaattttttcaatgtcttgataatgcgtcacccgttcaaacatcccacttgtcacggatgatagttgggtcgtgtccggatcgatcgcatcagcgtcaggtttaaattcagccttaaatgatttacaaggatgaatgatggtcatatggccacccttaattcgaccgtaactcgtcgttacccggccgatccacaggtcagagatatcttgatgatgaactgtccaagtgtcaccattccgaaaatgaaatttcaatgcttctaatgctcgttccattcaaatcacctcattgaattagtttcactttaatcgtaacagattcatagaaaatatcaatggttttttgaatccgctaccatccttgcaaaatcaagcaaagcatcctgctgatttgggacctgtttcatcaccacggcctgtaagcaagccgctagaatttgacccatcattggcccaggcgtcaccaatttagctttcaataaatcgccaccgttaatggccaattcatgcttgtcatggattggtaagctagcataagattgcaccaattgtgcttggtcctggccaaagcctaaaatcgtagccacctgattagccgttttcagcgcctctaagtccgtataaaagttctcctgcgcagttaactgaccgttgtgttttaacgccatcagcgctttaatagcggccgtcacgtgattaatcagctcattgctcgtcttccacgtctttaacaactggcgaacagccgcttcgtcagtccgttgcatggtccagctaagcaaggtccaagtactttcaatactcggcaaatgccaagctggaagtgccattaactgccgcagcatcgcttcttgatcagccattgcgggcatataacgatacaagtcagtggtcagcaagccggtcaaaccagcaactgggtgctgacccatcagcagcttctcccactcgacacgcgtccgttccacggcaattttcgccaacaacgccgcattatcggcaatcgcttgttcggtctgcgattcaatggtaaagcctaactgacttgcaaaccgaacggcacgcatcatccgcaacgcatcttcgtgaaaccgttcttcagccactccaacggcgcgtaagattccttgttccatatctgctaacccgtcaaacagatcaatcacttcaccgttagcagtcatggctaaggcgttgattgtgaaatcccggcgcttcaggtcctctttcaatgatcggacgaacgtaaccttatcagggcggcgaaaatcttggtaaccagattcagtccgaaacgtcgtcgtttcataaccattgccgtgatctaagatcatcaccgttccgtgctcgattcccgtatcaaccgtccgtttaaataattgtttgacttcagccggaaacgcgctggtcgcaatatcgacgtcatgtaggggcttgcccaaaatcgtatcgcgaacacacccaccaacaaagtacgcctcatagccggccgcttcgatcgtctcaataatcggcttagctgcttgaaactcagctggcaactgcgtcaaaatcatagtaagtgctccaaaccaacaaagagttcgtgatactggttaactttttcaaccgccactttgacaccagtcataaatgagatccggtcaaaggaatcttggcgaatcgttaacccttcaccagggccgccaaacatgacctcttcgtgcgccactagtccaggtaaccgaaccgcgtgaatccgcatcccttcatattcggcaccccgtgcgccaggtagagtttcagttgcgtcaggattaccttgttcctttggttgccgaacttcagcaatcttcttagcagtactgatagcagtaccacttggcgagtcaatcttatcgtcatgatgcatctcgataatttcaacatctgggaagtacttcgctgcttgttgggcaaattgcatgagtaagacggcactgatcccaaagttaggcgcaatgaggccgcccacttgcttgtcctttgctaatttttgcaactcggcaacttgttcatcggtcatcccagtagtcccaataacaggcgaaataccatggttaagtgcaaactttgcattttcataaacggcggttggaatcgtaaagtcgatccagactgtggcatccgtcttaatttggtctaaatcatgaaaagctggcacgtcttgacccttaaagcggtcgtcctcacctagattttgttctccactgcgcgcgtcatagaccccaactaattcaaaatcaggattatcaatgaccatctgagcagccgtactacccatccgacccttatagccggcaacaattacttttaccacaataaattcctcctcaagattaagctaattatattttagcagacaattgccaaattaggcaggagaatcctcgccgaacctgtttaaactgttaaactagccccattttgttcatgcccaatggctaaaacggtcccgctaattaacttgctactttgtgggacgatccacgtccgtcctataacactgatatgaataaaaaatagtgtctgactcaaagcgtagtcccgctcggtcgaacactatttgcttatatatttcggccgccaacaacacctggtgacgctaaattaacgtgtcaatcgtcgctaacaccccatcatgattattgtcatgtgacgtaagatacgtagccatctctttgacgggtgcaatcgcattttgcatcgcaaaactgtaatcagcctcccgtagcatttcaagatcattaccgttatcaccgaacgcggccgtttgactaggggcaacgtgccaatgttgctggagataagcaagcccggttgccttgttaacatgtggtggaatgacgtcaagcccattaccaccgctgacagtcgcacgtaaccggccagcaaattgctgattgatcaaagcggcgtgcgcatcagcatccgtggcttgccaactaaaagtcgctttatagatatggtcatcaattgctgatagcgatggcaccacttgcagccggctcaaatagtaccgcatgattggactgtcatcttggggccgaatatatgccccttgcttgccggagaccgagatctcagcaccagccagtgctggttcagtcgccacgtaaactaacagttcctgataaagcgccggctcaatcaagctttcagccaacacgttgccgtgattatcaatgactaacccgccattttcagccacataggtcaattcaccgttgatcccgtcaaaaacatcaatacaatgttgcagctgattgccgctcgccacaacaaagtgctggccctgagcattcatttgatccaactgggcctgaaaccgatggtgatcaaactgatggtcgtctctcaaaaacgtgccatctaaatcggtggcaattatagctactttcacgatagtaaacgcctcacttgaatttaatatacgttcattttaccaaaattgaaagtggtttcaataactttaggaatgaaactctcagcaagcggtgaagaactaaaggcctagtagccctgatcctcgtagtcttctagcatcgcaaccatttcaccatcatctggttcaatcgttagataattccgcaacgctgccacggcactgtcggccattcctgcttcgcggaagaaataaattgctggtttaaggaaatctttgttatgttcaaagaacggataagccgcttcgtaattatccttagccgcctgaaaatgatcgagccggtcattagagattgccaagttccagtagaactgtggatcaaactcattactttgcaaatattgatccaacaagtcgatattgtcttgataacggtcccgctgaactaacaaattagatagttccaataccgtggtcaagttatcagggtcaatactcaaaccttcccgcaaatacttttcagctaattcctgatcgtctaatttcaaggctaagcgggcagtttgcaagtacagctgctcattgtactggtcgaccgctaaaccttcttgtaaggtcaataacgccttgtccagttgatgaagttgctcttgggcctgggccaagtatggatacagggacgcatactgattgtcttgttcccgcagtttgtcgaagatatcaacagccttctggggttcgtttaattgcaaataagtgaagcctaattcaaactggctgtccggcgtgagcttggcaggcttgatttgttctaaatagcccaccgcctgctcaaagcgcccggactcagcataagccacccctagtcgttcaactaagttaactttagagatctctagttgtccctgcttgatcaagtccaagtagaagcgagtcgcctgaccgtagttacgaatcaagaagtaaaattctgcgagcgcaaattcgacaactggttcgtccggtgccagctgataggcttccttgagtttttgctcactgacttcaaataactcttgggtctggtatagatcggcctcaactaacaacgcttgaacgtatgccggtgagtctggcttaacttgttgtaaatagtcgagtgccaggtccgtatcgtcctcatcgatggcaatatcagccagacttgtccgtaagtcgtcctcatccggatacttagccagtaacttcttataagtccgttccgcttgctttaaaaagcccaaaccgtacaattcttcagccagactatacagcgtctggtcatcgtccttacgtaaggcccatgcaaagtgctttttggccgtatcaatttgcccgtttgatagtgctgcgagcattttttctgaataactcattacacccatcctttaaaccactaagaaacgactttatttagtcgccttggtttcatcatttattgcaatagtcagcctgatatcgtcacatgggataccagctgttaatcgcttgacctgacagtctatcataccgcagacgacagcaaaaaagccagtataacggtcgctatactggctttcatgtttgcatttcattaactgatatgcattatttaactgcgtcctttaaagctttccctggcttaaatgcaggtactttgcttgcaggaatttggatttcgtcaccagtttgtgggttacggcccttacgagctgcacgttcacgtacttcaaagttaccaaatccgatcagttgaactttttcaccctttgcaagagtgtcttggattgatgcaaagactgcgtcaactgcagcagttgcgtctttcttcgttaagttagttgccgcagcaacgttgttaactaattcagctttgtttgccatgtttgattcacctccccgttacagagtgaaggatcgccgtgctttttaacatcgttgatccagatgatcatttttgagtggtccaaaaatgagagaaacgataacaagcatcatttcttcatcaaagatagcataggaatgctgtaatagcaagcttttttagccttttcagcgaaaatagcgcaaaaagatgataatcgtttacatcaatcaaataatgtgctaaaatgctgattttacgcgctttagcctacttacgtcgccgttcaatcatatggatcggcgtaccactaaaatcaaaggcattccgaatttgattttcaaggaaccgttcatatgaaaagtgcatcatatcagggtcattcacgaagaccacaaaagttgggggttgaatcgccacctgagtggcatagtaaacccgtagccgcttaccattgtcactcggtgtcggattcatcgcaatcgcatccataataacgtcatttaaaacggacgactgaatccgccgcatatggttcgtattgactttcttaatcaacgcgggtagttgctccaaacgttgattagtcttagcagagacaaaaataatcggcgcatagctcaagtaaacgaactgatcacgaatatacgcttcgaattcttgcatggtgtggttgtctttcttaaccagatcccacttattgaccacgatgataatacccttacccgcttcatgcgcataaccagcaacccgcttatcctgctcacgaatgccttcttcaccattgatgacaaagagtgccacgtcactattatcgattgccttgagcgcacgcatgacgctataacgttcggtattttcgtaaacttttccttttttacggataccggccgtatcgaccatcacaaaccggtcaccatcctgatcagtaaacttggtatcaatggcatcccgggttgtcccggccacgtcagaaacgatgacccggtcttcacccagcaaggcgttgacaattgatgacttacccacgttcgggcggccaatcaaactgaaacgaatcgtccccggttcgtcctccccactttcttcaggaaagtttttgataacagcatcgagcaagtccccaagtccgagtccatgcgcacctgagatagggtacggatcgccaaagccaagggaataaaagtcatagacttcactccgaagttcagggttatcgactttattaacacccagcacgaccggtttgttcgaccggtacaagatttgggcaacgtgttcatcagcgtccgtgacgccttctttgatgctaactaaataaataatgacatcagcttcatcgattgcaatttcggcttgctgtgtgatctgtttaatgaatggggcatcttcgatatcgatcccacccgtatcgatcaaactgaattcttgaccaagccattcactgttggcgtaaatccggtcacgagtcacacccggtgtatcttcaacaatcgagatccgatcacccgcaatccgattaaaaatcgtggatttaccaacgtttggtcgcccaacaatggcgacgactggttttgccatattaattcctcctttaccctcgtagcgtcaggttcctgctacgagtctcaaattaattggtaacaccaactaatctgttcctaaaaaaatatccttcaaggcaagcttgaagggtatttttaatcaatcaatgattagttttcatcattgttgctttcagcattcttcaattcgtcaccgatcaaatcacctaaagtgaaaccagttgattcttcaggagcattagccgttgaacgttcgctagcagtccggttgtcccggttgttgttacgacgacggttattgttactccgacgttctggttgactttcgttgtcatcgtcagcagtttgtggcttttcttccaaagctttaattgataaagctaaccgcttttcgtctggacgaacgtctaagactttgactttgatttcttgaccaacttttaagacatcgtttggtgttgcaatgtgttggtgtgagatttgtgaaatgtgaactaacccttcaacaccagggaagacttccacaaaggcaccaaaactcgtcaaacgcttaactttaccatcaagtacagccccttgtggtgctttttcttcaataccatcccaaggttctggtaaggttgctttgattgataatgaaacccgttcgcggtcagcatcaacggataaaatcttaaccgtgacttcttgaccaaccttcaatacatcagcaggcttttcaacccgttcgtatgagatttctgaaacgtgaaccaaaccatcaatcccgccgaggtcaacaaaggcaccgaagttcgttaaacgagcaactttaccttcaacgacatcaccagcttgtaaggtcttcaaagcttcttcacgttgtgcttcgcgttgcttttcaacaacggcacggtgtgataagatcaagcgattttcgctaggttcaatttcaataatcttaagttcaagttcttggcctttataggcatttaaatcttcaacataatgatcatcaatcattgaggcagggatgaagccacgaacaccagcgtcaacgactaacccgcccttaacaacttgagttaccggagctttaatcgtatgacctgcttcgtattctttttcaacatcgtcccaaactttgcgagcttctaaccgacgatgtgacagtaaataactgccgttttccttgtcgctgccaattcgagaaatgacaaccaagtctaatacatcaccgactttagcggcttcgttgacatcgtcaacccgttgtgttgagagttccttcaaaggaacgaccccttcaacaccggtaccttggataccaacaattacttgtttgtcgtcgtcgattgctaagacttcacccttaacaacgtcaccgacgtttacttcttcaacgctgtttaaagcgtctaaaagttcatttttctcttggctgttttcgttttcactcatgcaaatttcctcctgtcaacaataactctaacctatatcatagctgaaaatgcaatgaaaagctagctaaaagcattaagttaatgcaattagattgttgaactttgtttttttgtaataattttggcaatggcagcaacaacttcatcgattgacattggcgtcgtatcaacaagtgtggcgtccgttgcttgtgttaatggtgacactttacgcgttgaatctttgtggtcacgtaattcaatctcagcctgtagctgagccaagggcgtgtcgatccctttttttacattttcggcgtatcgacgcttagcccgttcagccgctgaagcaactaaaaagatcttaacttcagcattgggcaataccgttgtcccaatatcacgaccgtccatcacgatcccacctgcattggccatctctcgctgttgctcagttaaaatcgtacgcacctgtggtaacgccgcaatcgtcgagacgttattcgtcacgtctggttggcgtatcgccgccgtaatatcttcctgattagcaaaaaccagttgatccggctcgccgggtttaaaactgatcttgagcgacttcattgccgtaatcacagccgcttcgtctgctaaatcaacgtgctgttgcattgcccagtacgtgactgcccgatacatggcaccagtatccacataaatatagccaaaccgttttgcaacgagtttggctacggtactcttgccagctgaagccggaccatcgatggccacctgtaatgcttgcttagccattaactaacccctcacaatctgaaaaaatcgtgtattaacggacacgtaaccgttgaccagccgaaatcgttgcatcagatgataacccatttaattccaatagcttatccactgagattccagcattcgtagcgacccgatagaccccttgaccggcttctaccgtgacgtacttagtccctgaagatgattctgaggagctactactactgctagcgctgctgtcgtcagtactcgcactttcttccgagctggcagcagtagaactagcagccttggaactggcagctttagagctagccaaggctaagctactacttttagcagccgcctttttcgacgatgcggccgccttcttcttgctagcagcagtcgatgacttactggcagcaacactggccgatgacttcttcgagctcgaactagcaacttgttcagtctgttgcggattattaagcgaattctttttcaccaagaaataaccaattggtgccaaagcaagcaacaatattagtacgactaacacggtcgttagcgtagagttgctactgtcttgttttcgtttttgagttcgcgataaattgcccgagtcatcccgatcgtcttcaaaagttttgtcccacggcttatccgcttgggatttgtcattatcatttttttgactcatagggtgttcctcctcaaaaaactttcaaccaatattgtaacataacccggaattgatttctttaagaatttggtaaaaacaattgagctaagtgctgatcccacgacattatcgtggctgttggctcatcatgcgtcgccatcagccctaacgcagccagcggtagtggttcaccagccaactgacaacactgatctgtatgggtaacagctggctcaccaaagtaagttaacatcacggtccgatgacaagttgtcgtttggacgtaactcatgagcgcccgcaattctcgttccttagctacttggcgatcagcaaaaatcgttgccacggtcgttgggggagttccttgtagccagtatgactgcaaaaccttactacgatcatcagtcggtggctgctgcgcttgataacggctataatcttgctgaatttcattgggagtcgcagccgtcaattcgttcaaattccgcaccaggttttcgtcacctggtgcgtacaacataatcgccatcgcctgctgaccatcacgacctgcgcgcccaatttcttgaacatagtcggccaaagtcgtcggtaaatgatagtggatcactaagcgaatatcagctttgttgatacccattccaaaagcagatgtagcacagatcacatccaattgtcctgccatgaactgctgctggatcttgaaacggtcatcagtcgctaagccggcatgataagccgcgacccgtaacgtggttgtcgttcgtagccattccgctatcaaatcagtttgccgcttggaagtaaagtaaacaatgactggtccgcgcgcacttgtcactaaatgttgcaaggtcgcgcgtttactagcttcatcattgacctgttcgactgctaagtaaatattaggacgattaaccgaatataagatttgctgggcatctggaacggttaattgtgtcaaaatatcttgtcgaacgcgttgtgtagccgttgccgtgagcattagcgttgtcggtgcctgtaaccgttgtcgaatttgaccaaggcgacggtagtcagggcgaaaatctggtccccaagttgaaatgcagtgggcctcgtcgataactaataacgccagttgcacttgcatcagcgctgtttgaataatgtcttgacccaacatttccggcgaaatgaacaagaatttaagctgccctaaatgattcaacagatactggcgagcaccataatctagttgggaggtcaaagcagcaacttgcttttcgccttgatagtttaagcgagccacctgatcttgcatcaaggaaatcagcggtgaaaccaccacaactagcccgggcagtgcggtcccgacgagttgatagatcaatgatttgccggtcccagttggtaacactgccaagacatcttgacctgctaataatttctgaatgacggctagctgcccggggcgaaattcatcgaagccatatttcgttttcaacagctcatataattcatcttctgacatgctgacacctcataatctgaaatagccgaaattcaaaaaaatctagcgtgggtagcgcagcttgggcctcttggaatgaccagtttgcaatgtcaggctgggctgcaaagatggtggccaactgctgagttatttcatgattcaacaccatttcaaacggaaaatcaggcgaccaaatcgccacctccaacaagtgctcccgtaccgtactcatctttaagtgccgcgtctgcgcaattgctgcaagttgctgggtcttcaagaaagcttggtaagtttgctcagcgctttgactgatggcactcgcttgagtgagcactgacaacaactgggaaaatggatcacgcgggtgtcgctgaatccaagcaatccattggcatatcacgtccgtgtgcatcaagctagcctcccagggttgtcgacctaattgtgccgctaattgctcattagtcagtcccggttcttgataccccgttataccttgaacaaacaccgttggcaactctgggtctgccaaactcgtcaagaaggcagtcaaggccgcatgaatttgctcgccaagttccaccttcgactgctgacgtagccattgtttgacctgggcttgaatccccggatcagtcgtcaccggataataatggcgatcatgatgtacgagttcggaaacgacttgtagggctagctgactgacgattctaaatcggcggacatcagtggtttgaaacacttcaaaattttggggcatgtataaagtctgtcggagtttggcttgccgatgttcccccgcctgcgttaattgccagcatcccgtggccgtactcgtcaattgaccgttttcagtcaatgccgcagttgctgccatgaaatcttccaagggaacctcgtggcaactgtcgagcaaatccaagtagccggcagttaaccccgcaaaaagcgtggagaccgtacggcgaccgcgcaagacattgaataggccctttgctcgtcgcggcgtcgtactgaataacaataaaacgtagtctgtaaacacgctaaggcctcccttaagtcttgctgttgtaattgttaattgcgcactaaatgtgccagtttttaaattaagtcgtgatcagcccaaatttacgtgcgtcagtgtcgctgacagtgacccgcgacaaagcatagcggccaacagctttttaatctttctaagccttaattgaagcttcaaattcatcaacttactgccacattaaagctcatggataaccatccgccaaccggcagtgtgcgtctttaagaatatcacggtggcaccaatataaaaaggcagtcaccctgcagttacgcaattagtgaccacccacattattttaacgacttagattaaattcggctcataagctgattatggttgcctaaccacttagctaatcgctgatagaccagccagaagacgttgcccactagcaatcccttgatcaagttaaatggaatgactgccactaacaccactgtattcagcgacatgctgagcttcatacccattacttgcaaatagaatggcagaacaaacgttaagttagccaacgattcaatcaccaccaggccgattgtggcgaccacaatcgccacaggcattcgccacttgggattgccccgatagtaacgaagtactaatgcaaatgctaaaatcaatactgccgtacctaaaaaactagcaaaagaaccgattaagtcatagatggcaaagcccatcatggccgaatgtaggagcagtttgatgatagtgatgacaaacgcgcccccgacaccaaagagaaagagcccaatcagaattgggatatctgaaaaatcaatcttcatccatggcgctaccggtaaaatcggaaactccagtaacattaaaatatacgcaatggcaccgagtaaggctatgcccactagtcggtgtaacgttgtatgttgcataacgcaccctcctatgggtcatcttcaatgaaccgcattaccatttgttcaactaaaaaagtccgcccgatcacactaactgtcatctgggggcggacttacttgcaacgcttggcaaataagctcgatcttctttataccagactttactgtcgactttggaattgcaccaaatcactatgcacacgcataggtcgcgggttattaccgccggtcgggaatcacaccctgccctgaagatgaaccaatatttatttttacaaattcattttaacggctttcgttcaaaaatgcaagcgctatcgttcaccttttaacttactaatttcaatcggcttcaatttacggtattcgcccggttgtaagctttgcaaatcgagaaccccataacgttcacgtttcaacttagtcactgggtgacccactgcagccaacatctttttcacttggtggttatgaccctcgtgaatcgttagttggaccagcgcattattcttcttgtgatcactatctaacaagttcgacttcgctggagctgtcttacggccatcgatttcaacacccaagcgcaattgcttgagatcagcattggttggtaccccttcaactttggccaaataagtttttttgacttcgtacttcggatgagttagccgattagcgagagccccatcatttgtcatgatcaacaaacctgaagtatcgtaatccaaacgtcccaccggatagattcgttccggtacgtcttcaaagaagtctaataccgttttacggcccttctcatcatgaacagttgtaacgaccccccgcggcttataaaataaataatacacgagtttttctgcattcaatggcacgccatcaacctcgacatggtcactaggctcaacctttacaccgagcgtggtgaccgtcttcccattcaccttaacgtgaccagacgtgatcaacacttctgatttacgccgcgaagcgatgcccgcttccgccattaccttttgtaatcgttctgccattattcatcctcacgttctgcttgtaatttatcctgaaatgcatttaaaaagaggtctgtctctggtgccggatgctcagcgtcacttaaagcagctaggtcaatcgctggtaagtcatccaaagactttagtccaaaataatctaagaacagttccgtcgttccgtataaaattggccgtcctggctcacttaaacgccccgtctcggtaactagttgtcgcaaaaccagcttttgaatcgttgatccactgtgtacgccacgaatctcatcaatttcaatccgcgtcaagggttgccgatacgcaatgattgctaacacttccaacgatgcttgcgacaaactcgtggtgagtggtgcttcaaagtagcgctttaacaccggcgccaccgcggccttagttgctagccggtaagtattcgccgttgataagatcattaaggcactgtctgggtcggcttgatacttcgtggccagttgtgtgagcatcgttgtaatcgccggcttagcaaaccccgtggcgtgctcgatttcggcgaccgtgatgccctcatcgccagccacaaataatagtccttcaatttgttcaatgttcgtcatgctgttcatcctgtcgtaaatataaatgaatcggactcagtggctcagcttgctgcagcgccacttgatcctgcttggttaattctaacacagccataaaggttgtcactaacatttcatcgctggcactaaccgtaaataggtcggcaaaatccagtccttgtggttgatgttgcaattgcgtcgtaatttgtgtcatccgctcatcaatgttgatggtttcagccacaaccgttttcgttagtggccgtacccgccgccgtttagccactaattgccgaaaagccgcttgcagatcatctaatgtaatccccgcagtcagcttgggcgcactcagatcagctggtactaacatcgcttcacgcgtaaaatgttgatggcgcgcctgttctttttctcgcaattcaccagcggcttcctgataaaccttgtaagccaacagttcagctacaagtgagtcacgaggatcatcgtcctcattatcttcgtccatctcatctggttcaggctgtggcaataagaaacggctcttgatcgtcatcaaagtcgcagccataaccaaataatcaccagcaatatctaattttagcgctcgcatagagtgtaagtaatccaaatattgctgcgtaattgccgcaattggaatgtcataaatatccatcttgttttggcgaatgaggtgcaacagcaagtcgagtggcccctcaaactccgaaatcttaatggtgattggttgttgttggttgtttgtcacgattacgctcccacgcgccaatgattggcgccatttctaaagttcccatgacccgttgtttgggatacaacgcggccaactcatccaacatttgatactggttggccgccgtccgttcctcgggtgataatgaatcgtgatgcagtagaataaagtcactgccgacttcaatgccgataataccacagaaatcgccgtcaccttgccgccatagtaatagttgatggtcttccgttgactgataccactgcatctcagtttgtagatgaattaggtccttaaaatctggaataaatgacagtagccccattgctaccttttcataatccttccgatatttaacgagcacggtattgcctcccttgactgcttgattccgcaccgcatctatgcccgcggatgatatttattataaacctcagctaggcgttttttcgaaatatgcgtataaatttgagtcgtcgaaatatcggcatgccctaaaagctcctgaacgacacgcaagtccgcaccattttctaagatgtgagtcgcaaacgagtggcgcaacgtatgcggcgtcacgtttttttcgatgccagccgccttgacttctgccttcagatttttccaaaccccttgccgacttaatttaccaccgtgattattaataaacaaatagctattccggcgtttggcagagacgagtttgggccgagccgtttttaaataacgggtaataaaatcaatggcaacatcaccgataggaataatccgctctttatcacccttaccgattgtttgaatcaatcccaagtctaagtgcagatcatccatcgttaaattaattgtctcgctgactcgcagaccggtcgcatacatcacttctaacagagttcggtctcgtaatcctaacggggtattcaacttaggcaccgctagcaaccgttcgacctcgcgtggtgacaatacttgcggtaaatgctgcgcccgcttaggcgtgtcgatttttagcatcggatcagtatcgatagcgtgcatctgtgctaaatattgaaaaaacttacgtaaactagaaacactgtgaatgattgtatttcgcgatttaccagcctcatctagatactgtaaataattcaataggacgtaccgatcaaccacccgatagtccgtgatttgctgactcatcaagtattcgctaaacgtagtcaggtcctgagaataactcttaatcgtattctcaactaacccccgttcaacacgcaaaaaatgcaggtaatcagcaagctggtcctgcattttttgatcaatcgtcggcttgctcatccgcattttccagtaacttgatctcgcctggttgttgactgatcaagcgttgcttcaagagattacccacagcgcgcttaaattgtgatttgctgataccaaagtaattccgaatatcatcgggatcactcttatcccaaaatggtagcgcgtggtcagcttgatgttgcaatgctgctaataacatttgggcatcatcgccaatttcttcgtatccccgcggcttcaaggacaaattcaattcaccatcgcgcaagaaaccaatgacccgcgccttgacgtgttgccccatgcgtggttcctgttcacgttctgacggatgaacaaagcccagatgattgtcatctgtaataaccgacgtaccggccatcttcaaacgaaaaacggtcgccatggtatccgtattcttaacttgagcccggtcatatggcttggcaattgcttcaaaatccgtcaattctgccagcgtcgcccatagccgttgcttattgtcacgggctaacttaacgtataaacgatcatcttttttaggccatagtcgactgatggtcggtaattcgtctaatgacaccaccaagtccttatttggtaaaccaacatcgacaaagacacccagatcatgccgcgtccggacaaccgttccccacacaaagtgatcaaacgaaatttccgggacgaaccgcgtcatctgcagatgatggtcttcattctcataaacaaaaccttcgtaaagcccgccaatgtgcaatggattctctggttcagttttatcgacccacaacgtctgtccatcaatctgtacgaagtatgcttcatcgttttcatcggttaccttcgccgtaaccactgttccaataatactatccatgtgataactcctctaatatatccgtctataaatatcaacggatggttcttttaaattactgtaagctcaaatgcaagacttgaataatgcaataggttataccagccgcaataattggcccggccgcgattcccttgagcaaaacaacacccataatggtcccgaatactaatgccacggtaatctctggtgtcgctgacaaaagcccgacaccgtgaaatgagagcactgaaaccaacactccacatgcaaccgcaatccagccaactggcgacttaaacgcatgccaaaggtcccgaaatccaatctgaccagtcgcaatcggaattaaaattgcgacggtaatcaccgtcacaccccaattgattcccttctgaccaatcgtcgtcagcaatttactcgtattaggaatcaatttgataagcaacacaaccacggtcgcaatttgtaaggactgattttttcctaaccatgccaccactaaaatcgctaataaaaataaccaactttccatacgacacctcacgtgttatcaattgtaactgaaaatggcccgaattacgaggggtgttggtcgttactcaccaatttcactatccccccctgatcaataaccgattcctgttctttaatttaggcgggaacagggttaaaaggtgccaaatcgtttggattccagctcgtcagcaaggttcgtcctattccgacttacggggctgggtgacaattgccggaacgtagccgacgtcgatttgagctcacgcagcaacccaccgcgtcatctcaaatacgagtcttattctaagccggaagcaacccacttccagctaagaataatttggctactgagcattgcctagccaacggannnnnnnnnngccgaaatgcctggaagtcggtataggacgccgctagctaagtaaatttccgctaagtagatctttttccagcgggcttaagctggatcatttgacgttgacgatttggcaccttttaaccatgtttcatactaatttaactgggagtgaagcactttatgtaatataaaaagccgccgcaaagcgacgacttttcaatatcaaattagatttgatcttaaagggcgtttgaagcaccgcggtatacaaggccacgacgtgaatcaactgtgatcaattgaccatcagcaataacactagtagcgtccttaacaccaacgataacaggaattcccattgagataccaacaacagcagcgtgtgaagttaaaccaccgttttcaacaactaaagcactagacttttcgattgctggtaagtagtctttgtcagtcgtcttagtaactaagacgccaccttcaacggccttgtcgatagcttcttgagcagacgttgcgattacggctttaccgataaccgtttcatcaccgacaccttgaccatcagctaacttagaaccaattaattggatcttcatgatgttagtcgtaccgcgttcgccaactggcacaccggcagtgatcaagattaagtcgccttccttggcaaagccaagttcaacagccttagaagcagctaaatcaaacatgtcatcagtggtttctggtttttcagccacgattggttgaacaccccagttaaccattaagccacgttgcgtccgttcgtcaaaagtgattgctaagatatcagcatttggacggtacttcgaaatcatcttagcagtgtagccagattcagtcgcagcaacaatcgtcttaatgttcaagttcttagctgcccgagcaatcgcaataccgattgtttcagtaacactagtcttgtcgaaacggtttaattgtaacgtaccgttttcagccaaagtgttttcagccttttcgtcaatcttagccatcatggcaacagattcaacagggtaaagaccgttagcactttcaccagaaagcatcgttgcgtcagtaccatcaaagacagcgttggcaacgtcagaagcttcggcacgagtaggacgtgggttttcttgcattgagtctaacatttgagtagccgtaataacaggcatacctaaagcattacacttcttgattaaactcttttgtaccaatggcacattttcagcaggaatttcaacacccatgtcaccacgagcaaccatcaaaccatcacaaaccttaagaatttcatcggcgttgtcgataccttcttgtgattcgatcttagggaagatttgaacgtgttccatgtgcttttcttcaagtaattcacgaatgtctaagacatcttgtggcttacgaacgaatgaagcagcgatgtagttgatttcatgatccaaaccaaagcgaatatcacttgagtctttttcagtgatcccaggtaagttgattgaaacgccaggagcgttaacacccttacgtgagcctaaaacgccggcgttttgaacagttgtaaccaattcgcggttagcttcgtccttttcgtcgatcttcatatctaataaaccatcatcaaagaggacatggccacctacatgaacatcatcatagaagttcttgtaagtaacggcaatcttatcatgggtcgtatctaatgaatcatccatggtgatacgaaccttgtcaccgatcttgtattcagattttccgttagcttgaacggtcgtccgaatttcagcacccttagtatcaagcatgataccaacggtcttacccgtaatcttttctgcttcgtgaactttgtttaagcgatctaaatgttcttcatgatcaccatgtgaaaagttaaagcggaaaatatttgcgccggcttcgattaatttaacaatagtgtcagtatcggtgctggcaggaccaagtgttgaaacaatcttggtttttttcataagaaaaatctctcccttgaaagtttttataaaaagacattaacgtcatttttatcaaattaaaataagaactaacatgccatgattacttgaatgaaatttcttcattcaacttatctaatgacacttcaacgtcatgcttagattcaaataaatctaagatgttgtggttgactaattggttgttttgaatcccaaccgctaagccacccttgccggcaagcaagagttccacagcgtaggcacccatcttgctggccatgacacggtctttagcagttggattcccaccacgttgcatatgagcaatggtattcccacgagcatcaaagtcaccatattcggataacttctcaacaaactcctgggcacccatcacaccttcggctaacacgatcaagttgctccgatgaccattggcccggttatgcttaatcttgttggcgatttcttccatgtcccaatcaacttcggggaccacaatagcagtcgcgccgattgaaacaccggaccataaggctacgtcaccagcgccacgacccataacttccacaacgaaagtacggtcatgactatgagccgtatcataaatccggtcaagggcttgcacgttggtgttgacagcagtgtcaaaaccaattgtgaagtccgtgtaaggaatatcattatcgatcgtccctggaagaccaatcgtgttgtagccgtgttccgttaagcgcaatgcgccatggtaagaaccgtcgccaccgataacaactaaagcatcaatcccaaaccgcttcaattgttcgatcccttttaattgaccttcttcatgggcaaattctggataacgtgcggagtatagtaaagttccgccgcgttgaatcacaccatctaagtcggctgcttctattttgtgaatgtcaccggcaactaatccagcaaagccgtaattgatgccgtatgcttccaacccttcagccattgctttaccagcaactgcacgaacggccgcattcataccaggagcgtcgccgccactggttaaaataccaatgcgtttcattttttcacctcaggcaataaattgagttcgtaactccataagtgattctaacacttttcacgtggattgtctgttattttctaaaattaaatgcgttaaaaaacgccttcgtatcaagggatagcgttcttcatcaccacattatcgcgacctaataaggttgtaagcgctccaaccaaatctggattttctgcgacccaatactgtgaatttagttcaaccgttcgatgtgctgctaccgagtaaattagaactggattaggacctcgatattgacttaagatccttaaaatttccttttgcacagtcgccgttgcttgctcaggttgcaaccgcaaaaagagttggccggttggtttgggtaattgttccgccaactgccaggtgtttacgatcacttgcaaatcccgctgttgctcgaccttaccagtaattaacacgattgcttctggtttcaattccgcctgaatccgttgataggtgttgggaaaaatcgtcaagtcaatttcgccggacaaatcacttcccgttgcaaatgccattggttgaccacgtttggtccgaatcgttcggaccttagtaatatagaccagtatttgtgccggttgttcactcgtgagcgtgctgactaattgcgtatgtcgttgttgcgcgagccaatcatacgtttccacagggtgccctgaaacgtacacaccaagatactccgcttctttggccaatcgctcacctaacgaaagctccggctgttttttgatcttaggggctaatgattcaaataaactcatactgccaccggctaactcggcacttgacatcaattcaggcacactggtcagtagctctgcacggttcaaaccaaagtggtcaaaagcccccgcatagatcagtgcatccatcaaatcggctttgagccacttcgcgtcaatccgttgcatgaactgctgaagacttttaaacggtccgttcgcctgccgctcgtctaacacactcgcaataaagtcacggcgcaaccctttgattgagctgagtccaaacacaatggcttgaccattccaatcaaagtattgaccgctccgattaatatccgggggaataatcgccacttggtgctgacgagcttccgctagatactgtttcagcttcgttccattgcccaacacagaattcatcaatgaggtaaagaacgctccggaataatggactttcaagtaagcaagttcaaaagccatcttactgtaggcaatcgcgtgtgagcggttgaaaccatagttcgcaaattgttcaatatattgataaacctgtgtcgcaactgcttcggaataaccattctgttgtgcaccagcgataaattgttgccgcattttatcaatcacagcacgttttttcttgctcatcgcccgccgcaataagtcggcttcacctagtgtaaaaccgcccatgaccgcggcgacttgcatgacttgttcttgatagaccagaataccgtacgttggtcctaagatgggcgcaagttgttccgccggataactgaccggttcttggccttgtttgcgggcaataaaatggtcgatattttccatgggccccggccggtaaagtgcattgaccgcggcgaccaattcaaagttatccgggtgcagacgccgtaacacgtttcgaattcccgccgattcaaattggaagactccggtcgtgtcgcccgcctgaaataatttcagggtcgctggatcgttcaaatcgattttagtaatagccagtggcctgccagtttgacgctgcacataatgtagcgcacttgccatcaaagacaaattccgtaatcctaagaaatccatctttaacaaaccaaccgcttcaacagtgtccttagtatactgggtcatcatcatagtttcactacctgcttgtagtggtacgatctgaattaatggtttttggcttaataccaccccggccgcgtgtgttgaataatgtcgtggcaacccttccaaacggcgagctgtttcaaataataatttatttttagatgaatcagcaacgaggttttgtaaccgttgtgagccctggtaggcctggtcaagtgtaatatgcaattggtttgggattgcggcactccagtcactcatctcgtaagttgagaggccaaacacacggccaacatcgcgcaatgcttgctttgctgccaaggtcccaaacgtaatgatttgtgcgacgcggtcatgaccatacttatcatgaacataattaagtacctgttcacggcgattatctggaatatccaaatcaatatctggcatattcgcccgtttagcgttcaagaaacgttcaaatagcaagtcatattttaagggatcgacatccgtaatattgagtgcataagcaactaatgagcctgctgcagaacctcgcccaggtccagttgtaatctgggcctcatgcgcaaaattcatgacatcccacacgatcaaaaagtaatcatcaaagcccatctgatcgatcacggtcagttcgtgatccaaacggtcctggtaagcctgctgatcaaccgacggcgttattgccgccaatcgctccgttagaccagccgtgcataactgccgtaaataaacattcgctggttgtccagcgggcgttggaaattgcggcaactgtggctgttgaaattgtaattcaacttgacactgtgccgcaatttcggccgtagccgccaccgccgtcgtcaatcccagttgctcatagtcagccgttacggtgttggccggccgtaagtagtgactgccttcgataccttgtaacgattcgggctgttcgatctgttggccccgatcgattgctcgcaaaactgaaacggcaaagtaatcctttgcttggacatagtcgactggatctaacgcaactaccggcaattgatgctgttgcgcaaaggccgtcattgttgttcgcaatgcaggggcctgatccaaagaaatccctaagtaaaggctagcagagtcgaccgcctgcctcagcgtggtaatccaatcagcagctcgctcagcggtgttttgtaacaacagcgcagctagttcactgtctttagccggggttaagaccattaaatggttcaaataaggtaatacggctgttagcgacaatcctgcatccgtcgccgtctgcttcatcgtcgacaaccgcatcaagttttgatagccagcttgatctttcgcaagcacgaccagactaaacgtttgcgccgttagttcacgtcctaataagttcaatgttattcccaatatcggggtaatttctgcctggcgacaggcattataaaaatcaacaataccgtacatgatatcaacgtctgttaaagccaacgtggaatacccctgttgcttggcagtttggactagctcactaactgtactagtgctgtgaagtaaactaaaagtactcaatacttgcaatggaacatattgcgccactatcgccgccccctttcataaaatatcagctttcaactcgcatcgaaaacgtaacatccgatcagctacgtcaagcccgctcccaattgatgggtaaacaaagaatttaccagtctattcaatgccagttgatgaccaatcttgtcctcagatatattcgttactattcattataccaaacagttgttctaagcggcagttttaagtcatcagataacgtgcacggttatgtttactagggtttcaccgccgtctcgtcgtaattatatcagcctaattaaagccttaatatcccgttattacctaattgctttttcctgtcggtgtgttaaaataattttcattgggaggtgtcggaaaatgatgagacaacttacgattatcttttggagtgtcctcttcggtgaagtcatcggctatatcggtggcgccctcgaacaactctcctataatcctggtgaaattggcatcgttgccgcaatttttgcgctaatcgtggtcaacagcatcacttatattactaatcattcccaacccgctaaaggttcagataataagtaattaaaaacaaccagaggctttgcttcgcttagtctcagcacaacaaaaaaagacgagtatcccgattgcggttactcgtctttttttgttgtgtgcttgacgcgccagccaactagaatgctggtacatacccgaccctaacattcagattaatgacgcttacgatccatcacttgctttgagcatttgcagcgttttggcatatttctgctttgcgcgttgtgctgctgcccaaaatgccaaatcggccgctgataaagaaccacgttgtacattaatttttcgattcattttttgcatactggtcaaaccttttacgatcgtcgtccatgttcgcttactcctcgattttggagtagcttaacacgacagcgtcggcggtaacaactcttttctcagtatgaggttaaacgcacgggcgcaaggtccccctcgtccgaagctaagcgcggctaccatcatcataaaccaaagatagctgcctcacacctacacgatcaagccatccagaatcataggctcaaccaagtcacaataataatccgcctaaaaaaagctggaccgtgagcatcgcaaggtgctcacggtccagtttttattggcccaattatcgtcactgaaacgcattatcacgcgttcaaatcagtgattacgcttatgccggctgggtcgattggttttcgaagactaagtgatcgtccatcaaattaatggcgactgtcgattttggtgccacgcgccccgcaatgatctcttttgccagcggtgtttcgacgtgattcgtgataaagcgccggagcggccgggcaccgtatgccggttcatacccctgcttagcgatccacttcttcgcttcgtcagaaattttcagtgtaatctcacgatcttggagacgggcagacaaccgatcaatcaatttcaccacaatttcctcaattgcgcccaattgtagtggcgtgaacataatgatgtcatcgattcggttcaaaaattccggtttgaatcgactttgaaccagctgcataacctgttgatgggtgtcggccgacaagtgaccctggtcatcaacccccgccagtagcaactctgatcctaagttcgacgtcataatcaagatggtatttttgaagtcgacggtccgtccttgaccatccgtcaaccgaccgtcatccaatacttgtaacaagatgttaaacacatctggatgcgccttttcaatttcatcgaataacacgatcgagtacggattacgccggacagcttcggtcaactgaccgccttcttcgtaaccaacgtagcccggtgccgccccgaccaatcgcgaaacggactctttctccatatattcactcatatcgatccgaaccatatgatcatcggcgtcaaacaaattctcagccaatgctttcgctaattccgtcttaccaaccccagttgggcctaaaaacataaaagaacccaggggacgattaggatcttgcaaaccggcccgcgaacgtaatacggcatccgaaacggcatcgaccgccgcatcctgaccaaccactcgttcatgcaaatggtccgccaagtgtaataatttctcccgctcaccggcaaccagtttggctactgggattcctgtcatccgggaaaccacgtttgcaatctgatctggcgtgacggattcctcaactaaccaatcttcatgatgatcattggcttccatggccttcaactcttgttccagcttgggaatcgtcccgtgctgcaacttagctgcttgttccagatcataattattttcagcattttccaagtcgtgcttagctttgtctaacgccgactttttgtcgcttaacgcttggaggctcttcttttcactgtcccagcgttcggataaagcccgctgtttttcttttgcgctggcgagttctttttgcacatccgctagccgtttaacggaggcatcgtcagtttcattctttaaggcggcttcctcgacctctaaacgcattaattgtcggttgacttggtctaattccgttgggttggagttcatttcgacccggatttcagcagaagcctcatctactaaatctaaggccttatctggcaagtaacgatccgtaatataacgatcagataacttggcagcggccactaaggcgttatcatgaatccgaacaccatgatggatttcaaagcgttcctttaagccacgtaaaatactgattgtatcttcaacactcggttcagcaaccaatactttttggaaccgccgctcgagtgccttgtccttttccatgtactgacgatattcatctaacgtcgtggccccgatcaaatgaagttctccccgcgccaacattggtttcaacaagttaccggcgtccatactgccttctgtcttaccagcaccaacgatattatggatttcatcgatgaacatgatgatctgcccatcgctcttcttgatttccttgaggacggctttgagtcgttcttcaaattcaccacgatacttcgccccggcaatcagagaccccatatctagcgagaacaacgtcttatcttttaagttctccggcacatcaccacgaacaattcgttgtgctagaccttccacgatggccgttttcccaactcccggttcaccaatcaagacaggattgtttttcgtctttcgtgacaagatccgaataacgtccagaatctcttcgtcccggccaattactggatcttgattcccctggcgcgcctgtttaaccaagtcgacgccgtacttttccaaagcttgatactgatcttcctgattacgtgacgtgacccgttgaccccctcgaatacgatcaacggcattcttgacttgtcctgccgtgatgccttgctgattcaagtatttggtcaactgatcaccagtttgatccatcagcgctaaagccaaagtgtcggtcgcaaggtaatcatcacctaacgctttgcgcttagcatcggcagcctgcatcagcgtagctagactactgctcatactgccaccgtactgaacgttaccaccgctaacaacggcaatgtcatccagctcacggtcgagctctgtttgtaattggtctaaatcagcgccggcctcactaaagatctgccgaaccagttcgcctggttgcgttaaaaatttaaatagatggggcaccccaatttcttgatggcgccgtgtttgtgcgatttgttgtgcctgttgtaaggcttgttgtaaactttctgtaaattgttctggattcatatttacgtacctcctcaaaaacggtagcaaaaaggcagccgtcatagctgccaatttttgtttgacctttattgactattagagtataacccgtaaggtcaaataaggtcaaggatttagtcctggtcataattatcctgaacgatttgtaagacaacgtccacggcttgggccatcacttgttctgaaacgtattcaaaccgaccgtgcatgttctcaccaccagcaaacaagtttggtgtcggcaagcccataaatgagatcttggagccatccgtcccaccacgaaccggataaatggctggcgtgataccgagcttgagcatggcttgtttggccaattcaacgacccgcatatctttttcaatgatttcgcgcatattgtaatactggtccttcatgtcgaccttgatccgggccacaccgtcagccaaattcagccgatccgcaaccgccataaataaccgtttacgtgcttcgaacttatcgcggtcatgatcacgaataatgtaagtcatcttagcgctgtcaacggtcccgtctaaactaagcaagaagaagaacccttcacggccttccgtgtgttccgggacatcatgtgcgggtaacgccgattgaaaatcaacggctaactgcaaggcgttgaccatcttatccttagcttcccctggatgaacgttgacacctgtaatcgtcaccgtcgcttgggccgcgttgaacgtttcatactccagttcaccaagcggaccaccatcgacggtgtaggcataatcggcgccaaaggcaggcacattaaagtgatcagcaccagtcccaatttcttcatcgggaccaaaagctaaccgaatcttgccatgtttgatctcaggatgggccaacaaatattccgcagcactaatgatttcagcaacgccagacttatcatcagctccaagcagcgtggttccatcagttgtgatcagcgtgtgaccagcatagttctttaagtttgggaagaccgccggatccagcacatagtccccgtttccgagcttaataactgattcaccgtcataattgacaacaatttgtggattgacattttccgcgttaaagtcagccgtatcaatatgtgaaataaagccaagagttttaacagctttgtcactattcgcaggaatcgtcgcaaaaacgtacgcactttgcgcatcctgttcaacatcgctcaagcctaaatcagtgagcttactcattaattgctttaaaaaggccgtttcacgtggtgacgaaggaattgtcgttgattcctcatctgaacgactattaattttgacaaaggttaaaaaatctgaaattaagtttggatattttgacatatgataacttcctttccttattaaagttcatgattaacttagatgaaggtaaacggatcagtattcagctgagacgccacaatctcgattggccagccagcttgtacacgccactgatcaaacagcttagtgagttgtgacttacaaatactctcgatatggtggcctggatcaatgaccgtcaacccggctgccagcatatcatgaccggtgtgataatagacatccccggtcacgtaagcttgtgcacctgctcgcaacgcttggggatagaacttaccaccatcgccgcccaggacggccacacgggtaatccgttgtcggggatcggcactgactagtcgcaggccgctgacaccaaatacttgtttacactgttcggcaaatgcctgcgctgataacggtgtcggcaaatcaccgactcggcccatataatactgatgaccgccagacaacagttgcacgacctggtaatcccacgtgtcagcggctaagtcattaatgcccgctaccgcagttggaatctgatcggctagtaagtcgacgctgaactgttcacccgagttgacagcgtaacgatctagcgtggcacccacggtattcgttaagtattcctgtaccgtttcaacttgattggtcggtaccgttaaagtcaacttaacagcctgtgcacgatacccaggaaccaatccctgcacattttgcaagtctaaggccgccgcaagccaatcgttcattccgccctcagcacagtccagattcgtatgggccgcgtacaccaagatgtggtgagctgcaagttctgcatacattgctttctgaggatcctgataatcaagattgttggccggtcgaaacatgacgggatgatgagcaaaaatcatgtcagcaccgatcgtgatggcttcttggacaacttccggccgcacatccagggtaactaacaccttgtggatatcctgatgaggatcgccgatttgtaatccggtgggatcatgctcccacttcaacttgagtggcgcaaatttttcaaaacgcgcaattaattcacttgcttgcatccgtcaagactccttcaatcaatttgattttagcgtgagccagcgctaactgttcctctggtatcactttagcccgttgcatttgcgcaaccgccgcatttactcgttgtaactcacgttgccacttagcgataaacaccggcgacttctcagctagcagaaacgggccaaacatctgttcagccgtcgtatacgtcacctgatgatcaacccgatcagcacaaagaatctcataagtatggccatcttcagctagaattcgttcagctacaatttgaaactgattggccgccagccattcccgcacggtcgcttcaccaacattaggctcgagtaccaaccgttgaacaccggcgagctgggtcggcccctgttcaagaatatggcgaatcaaagggccccccatcccggcaatcgtgaccgtatcaatacgatcagctggttcaatcgcagcaagaccgtcagctagacgggccactaagcaatccgttaaccccagcttttgaatctcatgacgcgcattttcaaagggcccccggacgacttcaccagctacaccataactaatttgatgatttaatgcgagattagctggcaaataagcgtgatctgacccaatatcggccacgcgggcgcccggctgaacgaaagcgccaaccgttgctaatcgttttgataattgttttgcatccacatacagttcccctttaattcgggaagatttacccacacgactaactttcagtggttgtggtcaaatccacccggttcaattgttttaattattcagtttaactaaccacgcacgtcactcgctatccttagtatgcaccaaaatcgaaacgtgctggtcgttgaattacgggtcggctctttatcagaaatacccaacgaggttcaactaagatcatggcgatacccaatggcctggaagttagcagtctgaacaaaggtcgcacactagattagacctttgttggccaatcatctttgaccttaaaaaccaacgcatttcaatggtgattcaggatagcacccgtatcaccgtacgttactaatcatattttaccatgcttcactgtgaatacgcattcagctggttaaattttcctgaaaattcctaagctttgttcaaactaactaaaattctattaatgcaagtttggatgacaggcagacgtgccataatatggctaatgtcgactggcaagcgacatattatctaatgagagaaagtttgattaaccatgcgaaaacgtcttttaacgacgtcgccatttttgactggcctaaaattattagctattctgccgccggtaggtatcggatggctgatttatttaagccggtggcaatggctggcgttactcaaacatccacgacaattcagtcggcacgacccgttgctagggtttatcgtcctattaatgggcatcacgacgctcaatctcaatcaccacgattatcgtagtgttattctgtctgtcctaatgctttttgtattgggcaatctttggttgttgtgtcgtgagtccacgcagtcgattgcttggcacgagcttcgtaaatttatcatccaatttggcttgtatattacaattagtggttttgctttccactggcttaaccaagtattgacattaccaacgtggctgaagttcatgctgggtgacctattatggggctatgctgctaatcagaatcgcttgttcgggtccgcctataatccaaatgatgcctgctgtttattattgattgccctcggcttactattgacacagttaagtcatggaagtgttcaccccttcacgcgctggccgctcataaactggtttttggtcggcttactttgtgtgggcgtttatcaaaccaaatcgcgcacagggctcatgatcatgattgccattctgatcatgacgacttaccagctttgccgtcaccatcgcattttggttacaacaatcttgattgctggcagtttaattgtctggcacgttttccctagaagtgcttcgaccatcaccgcacttcaaagtcgcttgacgatttggcacaacagcttcaccgttttcaaacaggccccgtacctcggcgtgacgtattttggctttgcgcggcactatttgcaactgacgggaacctacgtcccacacgcccacgatattttgctcatgctactagcttcttttggtatcctaggcggtgccggctttatttacttagtcctcagcagtggctggcacttaaccaaatattggcaccagtatcgtacgccgaatttgcgttactttatgatgactttgcccatcattctagcctatggattgacagacttcgttttatcttctatgcaagtattgattattattttgctcattatcgcttgttggcaccacgaacaacaattgcggccaatcattggccctcgcaagtatcagtctccacttatctgacacttttcatcaccatcaatttcgaacgggcagtaattccccatttcaaaaatagtatgcgctgccggtcattaagccgcaacacacactatttttagcgtaccgttaaccaaatcggcgatatgccaacacagttaacggcataaaaatcacaataataaggaaaccacttaacagtacaccaaatgcatcgggcccccaatggccagtccgcaaaattgtgcgtatcgcggtaattgttagactgaccggattcaatcggacaattgtttgcaacaaatgtggtaacgtcttagtcggaataaaggcgttagataaaaaggtcagcactaaaataatgatcattgacagactgccaatcagggccgcatttttgaccattaaaccaactaaagcaaagacccatgaaagcgaccatccaacaaatactgccagcagtaaaacgccgatcaatactagcggactaacaataggtcgccagcccatcataaaagctgtcaccagtgccatcaagccagaaataagcaatcggaaaacatcccccactaactgaccggctaacggtacgatcggtgaaatcggtagcgtcttgaagcggtcaaacacccccgcgttaatgtcttcacgtaattgctgtccggatcccgatgctgcattcaaaatactttgaatcaaaataccggtaactagcattggtaaataggcctggacactgcccgcaatggccccatcaaacaagtaaccgaataatagggtaaaaataattggttgtatcaccacgtcactaacattatctggattatgccacatttttaataagttccgatgcgtcattgtcaaaacatgacttaactctgctggttgtttgatttccatcgctttgtcctcctctaatttgtgcccacggtcagtttaaaaaacacatcatcgagcgatggcgcgtgcatcgcaaagttactgaccgtgatttgagcagcttgtaaccgcatcagaatttcagtgaccggcgtcaagctagcggtatccaacggcactgttagggtccgttccgcaacacggacatcttgaccgagcatggcttgtaagatatccttagccggtgtgacggccgtcgtcgcactgacttccaattcaagctcttgaccccctactgtttgtttcaaagcggtgggcgtcccactggcgactaactggccatgatctatgagcgcaatgtggtcggctaactggtcggcttcttctaagtactgagtcgttagcaccacagtcgaaccatcggccactagttgacgaatcgcttgccacatctgcgctcttgtccgcggatccaagcccgtggtcggttcatcgagaaaaagaatggccggtttaccaatcaagctaaccgccaaatctaatcgtcgccgcatcccgccagaaaatgtggccaaaacgtgatccgcagaatgcttcaaatcaaaatccgtcagtaattccatcgctcgatgcttcgccgccgcacggcttaaaccattcaagcgcccaaaaatctgcaagttttcccgcgcactcaggtcctgatcgatactagcggtttgaccggtcaaaccaaactgctggcgaacgcgtcgggcttgcgacaatgaatcaaagccattgactaagattttcccagcatcttgtcgcaatagggtcgtcatcatcctgatgaccgtcgttttacccgcaccattaggacccaataagccaaaaatttcaccccgttggacttgcagtgacaagtcttgaacggcgactttcgttccaaatcgcttctgaacatgtgtcatttgaatcatcatttcttcatccaagttaaaacctcccacaaatcaatcaggtgccctgactaaattgtcaacgactaattattgaccatcaatctaaaaatcaactaaccttaacgtaccgcataccaaagaatgttgtatacttaagaaaagaacgaatggaatgatcaatcgtgacaacgaatattaaggcggaactagtcgccggaaaattggccgagtacgaacaattaagcaaaatttatgatgacattgtcaagcaggcccgtccaagaataactgttgaaggtcagggcaagattctactagcactagccgatgaggaccacctctcacaaaaacagttggcaagtcgccttggcatgtcgccgcaatcaacgagcgagttcgtctataaacttgtcaatcgtcagctggtcactttatccaagtccaccaaagatcgccgcgtcaaccttgtgaacttaacggctgctggtcgcaaagagattgcatccgcagcccaggaggtccccccatttgtcaacacgctttctgacgacgagctcgatcaactggcacccttgttaaccaaaattaccaccgcgatgtatgcggatattgacgctgccaacccgactttgggcgttaagtttcacaaattatttgctagtcggtacttgaaacagtttaaaaagtaaatcatatgccacctgcccgtcatttttagatgacctcttgctccgaattaaccctgaatcagtatttggctctaaacaaacttaaaggcggaccaattcagttacgaattggttcgcctttagtgattatttaacttttaacaggaatcatagtttaccatttataatcaattgggtcctgtaagccccggccagtcgctttgtccaacataatgcgttgttcaaagtgcgccacatttcgtttagtctccttgaccatatccggattgactgaaacatagtcgatgccgctttgaatcaggaagttagtaaactctgggtactctgatggtgcttgaccacaaatcgaaaccgtcttgccatctttatgggctgtcttaatcaggtgccgaatcgctcgtttaacggccaagttccgctcatcaaagaggtgagccaccgtatcattattacgatcacaacccagaatcaacattgcaaggtcattcgaaccgatcgaatagccatcaacgaattgattgaattggtcggccaaaataatgttggttgggatttcagccatcatatagactttgaagtcagcactccgagctaggccttcatcgcgcataatggtcgttactttttgtgcttcgtcaacggttcgtacgaatggaatcatgacatttaaattcttcaacccaaattcgttccgaactttcttgaccgcagccagttccaacttgaatgcctcgatatacttggaatcatagtaccgagatgcaccccgccaacccagtaaatcagctggttcatgcggctcgtatttgtcgccaccctttagattacgatattcgctcgacttaaagtctgagaagcgtaggacgactggccgtggtgccattgcccgaacaaccttcgcgataccatccgccagcatattgaccaccttttcagggtgaccctgctcgatcaagtatagtggatgttcatgaataaaggttgtccataggaactcttcgcgcattaagccgattccatcagctggtaaacttgaatatttgtcagccaaatcaggatcacccaaattcatcatcacgcccgtagcagttggagcaaagctctcggccgcaaccacctgaccagcaaccgccgtagcaccactctttggcttcaacatgctagcgactttaccttgataaacaaccccgttcttagcatcgaccgttacgacatcgccggtcttcaagacgtcggttgccgcgacttccttacttttagtgccgacaatacatggaatctgcatctcacgagaaacgatcgcagcgtgacaagtcatgccaccgttattagtcacgatcgctgcagctttcttcattgccggtacccaatctggtgatgtcattaacgtcactaacacttcgccttgcttaaactgatcaatgtctttcggattatcaatgacatgcacgaccccactggctaagcccggactagctggtaacccccggacgataactttggcatccgcctcatccacaacatcttcatcgtcagctgcatctttgtgcttattacgctgtgaccaaactgtttctggccgcgcttgaacgatccatagccggttggtattcgtgtccaaagcgtattccatgtccatataacaaccgtaatgccgttcgatttctttagcgtagccggccaattcaatgacttgcgcatctgttaatactggctgaccctgtaattcatcggggacggactcttccttagtcccgccacccggtaaccgcattaattggacaggttgtttgataatattcttttcaacgattttcattgattgtttatcgataacaaagtgatccggcgtaactttgcccaacacaatatattcacccaaaccataaatggcatcgatcacgatcttggaagcatccccatccgctacattgacggagaacatgatcccggaagccttagaaaagaccatcatttgaatcgccgctgagagggccactttttcgtgtggaaaatgctgtttgtgccgataatatgtcgcgcgatccgtgaacagtgacgagtaacattgttgaacccgattaacgacatcggcagcacctttaatatttaagtaagattcttgttggccggcaaatgaagcgtttggtaagtcttccgcagtcgctgaagagcgaatcgccacgaacggatcagtttgccccattttcttagcgagatccgcataggcttgttcaatatcagccgccagatctgcgggcattgtcgcattcacgatcaagttacgaatttgttcgcacgcagtatgcaattcatcagaattttcataatcctgaatgctggctaacaaatcattgaccttatcattcaatcccgtctgggtcatgaagtactgatacgcccgggcggtggttgcaaagccatatgggactggaacatccatcgatgacgtcatttcacccagtgaagacgacttaccgcccactaggttcacatcttcgcggtgtaattcatcaaaccataaaacgtttgccgtatcacgactactcataagattacctccctatgttcctgcacttgaatatcatcattatcaaacttaagttctgtaagcgtttacattaaccatttatattgtagttcatttttacacaaagtaaaacccattttcattattttatcggcaaaatatagttggtgatgttgactggttacgcccgttaaagttcaacacaggcttgaaagaaaaggcatttaatggggacatgttttcaaatcaactcggattataatgataaactgtaaggccaactaattaacgaacttatttcacaatatacgaaatcaactcattgtggacgacgcaacccagtgtttatcacaaaaacgcaaagtagccagcggtgattactttcatcaccgctggctactttaagcgtctagcactacaactatgacttaagtctaaatcgatatttcactaatccgcaagcacttcaactggcagttgcatccctttccagccttccagcgctcctgctaattcatacgcgtcaaagcctgcggatagtagcacgagtaacgccgtcttgcctagggttgttccccccgtccaatcgtacacgacataggtcttcgccggatccagttcactgattctggttgccagatccttggcaggcatcgcgattgcacccttgatttgatctttcttcacttgggccggtgcattccgaacatctaagacgacgtacttgcccgtcgcattttgcatatcggctaaaacggtgtgatgatcgatgtataagcttaaatatgttgttaacaattcaattttcttgtcattcataattaattgcctcactttttaattgttgggtgccttgcttgattttatccaataagcctttaaactgctgctgctcttgaaccttaaacgacgcaaaaattgttgtaaccgccttaaaattggccggtaaaaattgcgtcaaaacactactaccggcggcggtcaaatgaatggcaactgtccgcttatcatcttgtggatgctgcttttccacccagcctcgcttttgcaagccgaccagtaacttgctcacagtcgcccgagcagaccctagctttgtggctaactccgacggcaatagcgtgtgatcagtttcattttccagcaacattaaaataataaacttggattctgaaagttgatattgatcgagtaattgttcataggtggcttgcatggttcgaaatgtccactgaaaatccagaaaagccaacacctgctcagcatccgccgagctacttgctttgcccagtgtcaattgcactcgctgtttatctggtcgatcacgaaacgaaaagtcaggcattgaaatccttctttctaaagttaattagccggctaactacttttagaagtatacacgctttttcatcatcgtcaacccttaaatcggactagctgttattcgaaacactcaccatccaaataaccctagccatcaagcaccacgacatttttcgtttaaactgatgcagattgaaatcaatagattagcgtgcacgactcaacagaaaataagcagtcagttgtgaaacctcccaacactcatgaaccctgcgcacaccaggtccagtacaattgacactcaccataatcgcatatgctatactgatgatcacgatacctattgatttggaggagtaccctaatgcacaaattagctattttggtgatgacaattggccttgcacttgctggttgtacgacccaaacattcgctccagtgaagcatcatcggtccgtcaaagcgacgacccaaaaagtgattcaagcaccaaccaaaacatggacttttgatcaagccgttagttccagccaaacaaaacacggcgtcgccagcaatttagacatttccgtggttgacaaaactactgcccaatcaagctggaccactagtaacggccaatttttgtccgccggcgtcaaacatcgtcaagtttcgtacgccaaatggcaccatgatcagcaacgccatatcatgaaaagttaccgacaccggctgcatcacatgtcagttagtcagatcaacgcggttttgaaaaagctcggtgcctcaatccagattaacaaactgactgacttgatttacttggaatccggcaatcacaccgatccgttaccagtcaacaccgcctttgctgctaaggggcaccacctctacgctgtcaacattcaatattcagatactgaacaggcaacgaccattgaacggggccgcgctttcactgatactagtgccaaggcggcgcctaaacacgtcaacgtagcgaatttgaatggtacctggattgctgccgaaactacgactagcgctagcgatacaggcaagttgctgatcaaagatggctatctatatcagcatcgttatgatagttatgaacgatctgctatccaggacctcagtcactattcattaggctcactgaatcaaaacgtgacctatgcggccttcaaaaccgatgcagcccacgctggctatcaattaacacataccgccgttgccagtggtgatagtaccggtatgttatatctcatcatcaacgctaataaaatcattcgtatcaatcagcagattgttacgacctatacgaaaaccagtgccgtcgtcgctgctaacgacctaccgaaaacagacgttgatttatttaagcaaatggatcaaaaaaaagctggtgaagtcgccacgacgattacggtaaaggccggtcccgcgcaagttggcatgaccaatagtattaactatctaaccgaccccaatgctggtcaaattacagagacaatcgtggtcaactaacaaccaaacaaccaggcgcttcatttgaaaaattatcaggtagtcacttatcaaaaacgctacttcataaagcgcgcagcaaaagccctgttgacctaattcccacatcaaaataagcacgttgtaaaaccacactctggtgatttttacaacgtgcttattttgtcatcgaacatctgcacagcatcaataattttatgattaacacagtaacgcaatttcacgacacctcaagccgattcagaaagtggtctggtcaacttacatcccagtatgacacgacaattgtcccgctttaatcatgaagaatacgactaattacaaggttagcccctaatcatgctcgtattcacgtttaagtcgcatccatcctgcatgcagaccaaaagccgttgtaaaggacaataaccaggtcaaaccataacacagcgcaatgctcagccagggagccttgaccatcaaagtacgaccaaaaccacgccacaacaattcagaccagaaaacattcgctaagtatgccttataggccataccagcaaagaaatgtacaaatttgctaaaaggacgttgacgacaagcttgaatctcacacaacgccgccaacaggccgatgactgctagcgcataccccgtcattgatggtttgtaatacggggcgttgcgcaaattaaccgggaagccgtaactgaacagttcccaattagtccagatcaggccaactaaccatagaccaagtaatcccggccaccacttgttaagcatgcgctgaaaggtatctcgaaacacccaagctaacatgccatagaacccgaaaatctggaaactgataaaaagccggtccagtaaataccaatcacggctgtgaggaccatggaaaacttgttggtcataaaaccacaaccaaagaacggcgaccagtgttgtaccgccaaatacgatccagccgcgtcgaggtcgagactgacaccaacggccaagcgcccagaataacggcattaatatgataaattgtagcatcatggtgttataccacagatgaggcgctgcattaccattaacgaactgccagaaaaatccccgccagtcatgatactggctaccttgctgcaattgtggcatcaagattaagtagatcatggtccaccaaatcgttggaataaacagcgcatgccattgctggcgcaaatagtcggtataggtcaacgcggtctgattaagcgtcaaacgcgtcgtcgtatagagaatgccaaaaataaaggccggtgccgtatacttgaccagattataaacaacaccaatcccagtttgcgtggcaatcgacggcccacttgccaatgcgtctgtgagaatcggctgggccatcaccgcagtacaggcccctagtttgaggtaatcgccaacgttagtgacctccatcgacggactagaaatcatcgtcactgctaccacctcttcgaatttttaccagatcaaccgatggtcaaccttaaacccagtctaatagattcccatgggattacaagtacacttcgcgaacattaccagctaatgattgtattttttgatacgattccaactgctttacctttcaagcaaaccatacacttaagcgaccatttaggcaaaaaaatcgcgtcagaccagtcagcattagccgatttacggtcagacacgatcgtgatttctttattatagattcctttacagatttcaatccggtggtctaagccccacatgcaagtactaggctgagcagtatccaaccaccagattactcagcgttttggtccaacaacacaatgacctttccaaaactgtctgccgcttgcaaataagcatgggccgccggtacctgattaaagttaaaaatccgagcgggggcgaccgacacatgatatgctgcgatgaagtcaaataaatcttgcaacaatgtctgagaaacatcgccagaggaaaagcccgctaaataacacccattcggaatatcactaatcgggtcaaaatcaggaacggtccacagcccacctaattcgcccgtcatatttacaatgccgccttcgttgagatgcgacaatgaatctttgacactgagcggaccaatcaagtcgatgattttatcaaaatgagccgttgcggctggtaaacgagcgctatccggagcgacaatgacctcatcaaagccagcatcaatcaattgttggcgcttaactagccgccgagtagtcccggccacatggatctttggattataagctttgatcagatttaaatcggcaattccaaccccactagtagctgctcgaatcagcacccggtccgtcgctttaagctgcaaagacttaaaaatgccataggccgtgtagtaggtctcaggggttgccaccaatgaggcaatcgatagattcgttttgatcggataaacctgctcgttcggtaataatacgtattcggcataactaccatcatatgcccgacccatctcacccatgattgaaaccacacgttgcccagacgtgaatgttgctggcgcactggtctcatcgaccacaccaactacttcgattccgagcactcgtgggaactgcacgctcggtgacttgccttcccgcgtaaagatttctgagtggttgataccaaaacctaaaacttttacccgggtccaccccggtttgacgttcggttcaggaagtgtcgttaattgtaacgcttctggtccacctggttggttcacgacgtatgcttgcaactttgctacctccgttcgtttttaatgccaatttaacgatagctgagattcacgcttttcgcaattaattaatcccctgcggaatatcagcattgcaatcatttagtcaatcgtcgccagaggtcgccggccaccgtcaaaccgataccagtcattaacactaatacgatcactattaaagttagccagccactaatagccggcactccccaaccactgctagctaatccgatggtcaacagacagttcaagccgatggtcaacccaactgcgcgactaggccgtccccgccaaaatggaccactagtacgagtcatcaagattgttaacattgcactaaatatgagatagacgtaaagactagtgctcaactgaccagcagacaaccccaaaccatgcagccagactatcaaaccaacacccacagctgtccacccagtcgctaggaaccccgcaattttgcttaagcggggcatatcccactgttcgggacgatggcgaatgattgtgcgatcagtgccaaggaccaatgttactaaatcattcagaatagccactaataccatcgcattcagcgacaatggcacgtaatctagccataaatagccgattgttaaaagcacggtcagttcgaccgtccgagtgagtttggtaattgtccaagtcagcatccgctggtagacgcgatgaccactgtctaaaatcgtcagaatatttgccaaaccacccgttaacaggacgaacttagcacttcgtctggctaaatcagtggcattgtcaacggcaatcccaacctccgactgctttaatgctggcgcatcattaacaccgtcgcccgtcatccccaccacgtaacccgcgcgctgcatagctttgacaattgccaatttgttctctggaacaacttcggcaatcccggcaacttgcgctaacggtcgcgagtgcgttttaaaggtctggtaggaaaccacttggccctttaatccaaccgcatcagccacagcctgtgctgtttttaaattatcgcctgtcagcataatcgttttaacgccccggtgttgaatcctttttaaggccgccgcactatctgggcgcggttgatcttgcaaaatcaacacaccttgtaaaacattattaatcatgaccgccactgaacggccccgggtcaaatccagttggtcgattgctaaagccggttgctgtgcggttaactcgtacaaacgactaagtgcaccaatacgtacccgcacaactgttggcgcttcggcataaccaacacttgcatcaaatggcttaaattcctgctgtggcagccgtttcaactgatagcgatgagcaaagttcacaattgcttgatccaccacgctaggatgtcgcgaatcggtcgcgctagctgctaaccgcaacaattgctgatctgatctggccgacaaatttttaaactgcacgacttgcggctgatttgtcgttatcgttcccgttttgtcaacaagtaataaattcaaattggcagcttcctgaatacccgttaattcactgaccagaatccgctgctggctaagttcacgggcttctaccgaatttgcaactgcaaaacttgacggcatggcaatcggaatcgtcgcaatgaacagcatcgctagaaacggtaacatctgaatcatgtctgcatggcgaattaacgctattccaacaatgatgagtgctaaagcactgtctaacaatgccaagtaaccaataattttacccaataatcgttgtaaatgaccaggcgcattgttttgattaatcaaactgactgtttttccagcccgactatgacttccagtcgccagtacgcgtgctaaagtttccccggctaccaccattgtgcctgcaaaggccgtttcacccggcgtatggctaactgcaacggattcacctgttattgagctttcatccgtatgaattggattcgttaacacacgaatatcagctgggattacactccctacctgtaaactaatcagatcacccacaactaaagccttcgcatcaatcaactgccaatgaccagcacgacgtaccgaactggttggcgtcaattgatgcgccagctcctgtaaaaccaaggccgcacgtcgcgattgaattgcaccattgacggctgcaaagaccagcattaacgcaataaagccagcctgaatttctttacccaaaacaacttcaataactaaagctccctccaaaatccatgccgatggttcccatagacgactgactacggccttaaaaaagttaaacgttggttctgggacatcattaaatccatctgccgctagtttagcggctgcttgttgctccgttaaatcttcaatcatgtctgcatctcgaatttgacaagcaccactggcaacctaactgtcgaatcaggtttatcacaaataattagtcaaacatcacgttatttgggaagtgtgccaaccgagcaccatcagtacctaattcttcctcaattcgcaataattgattatatttttcaatgcgttcagagcgggctggcgcaccagcttttagttgagccgcattggtggccactgtgaaatcagcgacgaaagtatcaccagtttcgccagatcggtgtgacatcatcgtggcataaccatttttgcgagctagccgaatcgcggccaaagtttcggtaacggtcccgatttgatttaatttaattaaaatattgttagccatcccccgctgaattgcttgccgaattaattgcggattagtgcagaccggatcatcagccacaatttgaagctggtcaccatgagcagctgtaaagcttgcaaagttatcccagtcctcttccccgtatgggtcctcaattgaaacgatttctggaaacttcgctaataactgcagataataatcaccaagggctgccggcgtgtacgttttgccctcaaagtcataattgtgggtcgttcgattataaaaatacgatgccgccgcgtcaaaagcaatcgcaatttctttaccaggtgtataaccagctttaataatcgcatcatgtaatatttgcaaggcttcttctgagtttttaagatcaggcgcaaagccaccctcatcacctaaaccagtcgtgtacccggcatcttcgataacttttttcaaagtatgataagtattcacgatcttttcaaaaccgtcccgaaaactggttcgttcgaccggtgtaatcatgaattcttgaatatcaatgccattatctgcatgctccccaccattgatcacgttatgaaatgtttggggtagctctaaatcagtgccacctaagtaacgataaagcggctgctgtaatgcgtttgccgccgctcgtgccgttgccattgaaacacccaaaatagcattcgcacccagacgcgctttgttgggcgtaccatctaggtcaatcatgatttgatcaatatgggcttggttaaacgggtcagcaccatgtaaagcatgattaatgaccgtattaacattattaacagccttaagaacacctttacctgctaaacgatcaccaccatcgcgtaattcaactgcctctttttctccagtcgaagctcccgatggtacttccgcgcgtcctagcgtcccatctgacaaaataacgtcagcctcaactgttggattacctcgtgaatcaaaaatttcgcgagcctttaccgtttcaataacttgtttttccatatcaatctctccttcttaaccaaaaagaaaagacgcctactgtctgaaaaacaaacagtagacgtcatcaaattgattatcaattattatgtggcgaacgtcatcgccgattaacttttgaacaactaaagattacaccttctcaaaacaatgtcaatctttttataacatttttatcgttgaccagcttgacgcgtcttcattgccaatatcatggtccccaattcaatcagcactaaaatcagcaacaaccccaaggccatggttgatcctaacgctgtccgatgcgcactcgttccagtcgtctgtacttgaactaacgtgataacggcggacacgactgaagtcccaatggcccctgcaaactgctgcatggtattgaacacggcattgccatcagcttgatgctcagctgacaactgctgtaagccactcgtcatcgtattacccatggttaagccaataccaatcattaataaaatgtaaatggctaaaatccaaccgcctgacaggtgcatccccaacaccgtaaacagtgccatggcaataaccaaaattgttgaacccgttaggactggtttggctgcacccagactgtctagaatacgtccacctagtggggcaaaaacagccccgattgccgcgccaggtagtacaaataagccagctaacaaagcactcttgccgttcactaactggatgtagttgggcaatatgaaggccaacccgagggcacagatttgaaccaaaaagtacgccattaagtgcaaatcataagattttgtggtaaaaatcgccagattgattagcggttgtgccgctcgacgtgtgcggataacgaaccccacaagaccaatcagaccgaccactagccaagccacaaaaatcagtggttgcgtggtaatcgtggctaacttgctaaatccaattgtaaagccaacgaataagaggacgatcatcagccaaccgaccacatcaaatccaactttaactgtcggctgggcttgtcgaatcgcatacagccctaacacaagtgaaatcacgagtaccgggattagcaatacgaaaatccaatgccaatccatccaactaacgatcaagcccccaaaagtcggccccagtgctggggcgattgcggtaatcagcgtgccaattcccatcaaggtccctttctgccgtgctggtgcccaatcaataataatattaaacattaacggtaaagcaatcccagttcccattccctgaatgattcgtccagtgactaaaacgggaaaactggtcgcggtcgcgtcaacgaccaatcccagtataaacaataaattggctgtcacaaacagcgttttagtgcgaaaacggcgtttcagaaacgccgaaattggcacaataattgcgactactaacaagtaagccgtggtcatccactggaccgtcgccgtattgagtgcaaattctcgcatcaacttagggaaagtgatattcatcgcagtctccacgatcactccgcaaaatgaaagtaatccggcagccacgattgcaagaatcaatttgaggtcaacacgtttttccatacttaaaatcagctccttaacctatagttcgaatacgaactaattaactattttagcacactatttcaaaattttaagccctattttaattgactttttaacaattagttcttataattcactttagttagaatacgaaccataatatcattaaggagtcctcccatgcaagattcattagggatcatgattaagaaagcgaacaatgcattagccagggactcagaccattatgcaaaatcactgggactaactggcatgcaaatcagtacgatcaactttattgccaacaatgaacagcatcacgacctcttccaacgggacttagaattagagttcaatattcgtaaagcaacctgttccagcctcgtttccaaaatggaagccgctgatttactcattcgcgtgccagcaaaggacgatggtcgctacaaacgactactcctaacacccaaggcccgccaattagccaccaagatcgaacgtttctttgaaaccagtgaacaacgaatggcgacaattttaggggtaaataccgccgaaacttacgaagccctgcgacaaattgccgttgctttttcaacaccgacccatgcacctgaaaattggtactaaccattcaaagacccgctgacagtcactgactgctagcgggtctttgattttacgatcaatcaacaccgattactcggccaaaaaacgtgtaaacagctgttgataaattgcaataaagtcataaaacatctgttttggtaaactttcattgacctgatgttgggtcatattacccggtccataaaccgcaaagggaaaatcggctggttgacgcttagccaaattagaagcatcggtaattcccggacttgagacaacgacaacatcgcggccagcatagggcttgccaatggcctgcactaactttactaaccgattatcagccgtggttgcaattggtgactcattcatgatagcggtcatcttaatgtcagcaccttgctgattatacgctgcgatcaggtccgttaatttttgggtcacttggtcattatcgtattccggaatcgtccgcacattaacgagtgcagtcgctaaatcgggtaacgaatttacttggtccccaccgtttaacacgtcaatgttaaatctgaccggtcccacctcgcctgccggaatcgtttcaaaatagtcattggcttcattgagtaatttaatcagcgggactaaagcattatagccgcgttcgggtgtcgaactgtgtaccgccttacccttagacgtcaattttaagtcataagaccccttctgctcagccgctgttccataaaccgttgaaggttcagcaatcagtaaaccagctgcatcttgcatcgccccttgttgataaaaggcagctgagccagcttcaccaacttcttcgcccattgtcgccaacaagcgaatggtgccatgtttagggccaccttgctgctgaatattgatcatcgcagcgactaatgcgactaaaccagccttcatatccgtgacgccccgaccaaataactgaccggatttttctactaaggtgaaaggatctgtgtcccacgccgccaggtcacctgccgcaaccacatccatatgaccggaaaccgctaaaacaggctgcccatgaccaatctctgcaactagatttgcacgatcaccggtaatggggtaaatcttagctgaaatatcatacttcgccaacagggcttgcaaatattttgcaaccgtcaactcatggtcgttaactgatggaatcttaatcacatccgctagaatcttaagcgctgcatcgtcttcaatcgttcgcatattttgccaccaactttcttatgataatttcagtctaacacttctgaaccttctattttacccaatagcctctgctacgttatcaaattttgttgaaattaatatcttagttatcaatcatcatgttcgtgtcaaaattgaggttcgccccgttgtctgatcattaaaatattcatactgaactagttcggcatacgacccagcaatgttgaccacattcgtatagccgcgctgaagtaacgcgcggaccatattgtaacttcgctgtccagtctggcaatgaatataaactggctgattggtcggaatttccactaagcgctgccgaaactgactcagtggaatattatgagcgcccttgatgtgcccatcagcgtactcttgtggttcacgggcatcgatgataaacgcccccgccaagaccagctgtcgaacctgcgtcaccgcaacctgcttaaattcatcattcaggacgttttccgccaccaagccaaccatgttgacgacatttttggcggtactgacccatggcgaataacataattcaacatctgtcaggtcactgactcgaccgtgcatcgtgattagactagcgataatatcaatcggtttgtcaacgtccgattgaccaatggcctgcgcgcccaaaatctcaccggtcggataactgaatatcaacttaagaaagacggctgttgtcactggcatcacgctgacccgattctgtggtgccaccgttgcgaaccgataatcaagttgctggtgctcacactcagtagcgttcaggcccgttgacgccacgtttaacgtaaagatgtgaagaacctgcgatccgatcacaccctgatactgtggcgtccgcccgtataaatgatccaccatgtgtcgggcctgcatttgtgcgggaaatgccaatgctagccgcgtagattgacgtgtaagccgattagtcacttcaatggcatcacccaccgcataaatgtcggccacggacgtctggtaacgatgatcaaccttgataccaccggtcacgcctaacgcacaacccgcttgaaccgctaattcagttactggtgtaaccccaattgccacaatcactaactggctggtcacggcgcgtcccgaggcgagctgcacttgtgttgcaccaatggccgtcacttgttcttgcagtatcacctgcacaccgtaatcgtatagttccttgtgtactagctgagcaaactcgtcatccaaagtgcccaagacgtgttcggcagcctcaatgattgtgatctgatagccagcctgttgtaaattctcagccatctctagtccgataaagccgccgccaacaatcgtcacatcatgaacgtgttgttcagtcagatacgcttgaatcgttcggacatcttgaacattgcggaccgttttaacattgggccggtcgattcccgcaatcactgcgggtagtatcggtcgagcaccaggtgaaagaatcagtgtatcatatgggacgatcgtcgttgctacctgtccttgccgtttgatcatcactgtcttagcctgcgcatcaatggcgacaaccgttgtattcacttgaacgtcaatattgtactgttgctcgaattgcatcggtgtctttaaaatcacgtcatcgggctggtcaatcacatcactgaatgtgtacggtaaggcacaattggaaaatgagacatccggccccttttcaaaaattgtaatctgggcgaactcgtccaatcgacgcacgcgggccgccgccgaagcaccaccaccaacgccaccaacaatgaccacttttttcacttccatctgaaccatcctttcgtaggtatgctgtagccctgccactaattagcttaattttaagggtttcaaggcgtaaccacaacatcaacgccgattaattcaaccgttttcattaattgacgtcattggctttctatttaagctaaaataagttagtatgtgtttaacacttaaaaaagcttaaggtgatcaattatgaaccaaaaaacacgcttaacattgattcttgatgaattaaaaaaccacccatcactgagtttaaaagacattatgcaattaacggggacttcacgcgacactgcccggcgcgatattgtcaaactcgcagctcataatttggctgaacgaaactacggcggcattagtcggccgaatacgtttaataagctagatcaatacctggaccgggatgatgacttactgcaaactaaacgagccctggcccacactgccagttcgtatttactaaatgatgcgttattatttctagatatctcaaccaccgttgcctgtctaccacaatatctccagtccaagcaccccggcatgatcgttacgaattcccttgacattgctgaccaggcattacgacatagcaattttcaaacgcgtatcctgggtggcacattagatgcacaacaacggtgtgttcaaggcgctgacagcattctagcactacacaaatttcgatttacgaccacggtcttgagttgcgctgggttgaccgcagacggcgtttattacgcttacgaatctgatattgctttaaaggaaacgttacgcgcccaaagcgaccggctagtgctgttgtttgaccacaccaaggtgaacgtcagccacaacttcaacttgctagctctcagtgattttgattactttgtgactgatcagccactaccggataacctagctactaagattgcacctgataaacttatttacctttagaggaggatcattaacatgccatcttcactattaaccactcaacgggcaatgttagctctgattcaaagtggcttagcctacacgactgacccgttcgacaaagatcgctatcaaaagttacaaaccttattgattcaacaaatggccgccacttccaacatatcaactgctgacttaacgactgctctgactcaggattccggctacatcacccccaaaatcgacgtccgcggcttgatacgccatggtaatcagctactactcgttcaagatattaaaacgaaactatgggccttaccaggcggctttgctgacgtgggctacacgccgactgaaaatgtgcaacgcgaggtgtgggaagagactggccgtcacgtcgcggttcaggggctcatcaccgtttttgacactgctctacgtgtcgatattccccaaccatttcagtattataaattggtctttgcttgtgaaattactgatggccaatttgagcctaacattgaggtcgcccaaacagcctactttacgctcgacaacttgccaccgttgtcccaaaaccggacaaccgaagaacagttggcacagctaatggcatcttccactaccatcacagtcgactaaatgactgctgaagcgccaaaaacatcccgactagcctgtctgctagccgggatgtttttgtttctttatgacgtctttcaatcaagttaggccgctattggcatcaacaattatgaaaaagagcgtcggattaacattaatttacatcaacctagtaattaccattttcacaatatggtggactttaagtcccctatcattacatatccaccaatccaactaaggtttgttgaaaattcagtcgccgaatatgccggggaatgaattggcgaatatcatcatcattaaagcctacttgcaatttattacgaccaacaataattggccgccgcaacaactggggttgttcgcataacagccggagcgtctcattgaatgacatatctggcagcttatcagcaattgcgggataactttgtgaacgggtagaaataatatcttccaatccattctcagttaggcacagaatttgttttaactcactaacagtaggggctgcgctactaaagttcttctcctcaaatgcaatatcatgatcccggaaccattggcgggcctttcgcgatgagttacatcctgcttgcgtaaacaatttaatcataattatttcgcctccttgattagtgtttttattatgataattataacttgtttattattgtagcaggttattcataactttgtaaagacctgaacgaagtaatcgtaaaaaattcattgttttttcatatttattattgtttaaataatataaatgttatacgaatcaccgttgattttcatgctgatcaaacgcacgcagcaagcgtgacgccagcaaataggccacttcgtacttcaccgttaactgccacaagaacggcccaagctgatcgtgtgccggggttaaattcgttagtaaattcaggtaacgttgcttctcggccagcgtacaccgctttttaaaatagccccagacgtgctgataagccgttgtcaacgtggctttagttggcgtaatttgttcggcttctgctaataattgttggtagcgttcctgttttgcagctgaccaatcattgtgccgagctaattgtcggatggcattataatgctgctgtgagtgtgccatgacccagtacttttggtaagcccaatcttgttgccattgtgacattgctcccatctcctcaatcttttgatgaatttacaaatattgtaccgtctggctcagaaaaatagaaccaatttacattagtacactggtaacagtcgtaagttttgaaacttagcacaaaaatggcgatagcccagttacctgttggtgcaacttagctatcgccatcaaaacttatattttatgagtactactgttgtcaattcaagttaatcagccagaactgatgttacttttcgcctggccgagctgagatcatgagctcacgttgcggataatcttgtggatgttccaacatatcggtgatcaatgtcgccaatgagaatagactaagtggcccaccgctaacagcatttccagctggttcaacaattaactgatccgcttcatcattgtacttgaaaaaatgacaggctagcaatgtatagtccaaatcactattcctgataactgcagccccggccttttgccccgccacataggtcgtctcaacttcacgactaaacccaaactcgcggcgggctaaggtgtacattgcttctgaaatctgatcgtagttgatttgaaactgggtcgtccaaaatagccgttttaccccaactgcatccatcgcttgcaccaatgccgtggcaaactgcgccgcgtgggtaatgcccaccgttgagaatacgacgtcaatccctcgcagcgcgcgttttaaatcatcaacattgctcgcatccccgattaactgcgtggctaacgagacatcatgctcatgccggtgatgatccaacaaagtcacgtggtgctgcggcatcacggccactcgacgatacacttcataccccaatttacccgttccaataatcaaaatattcattactgatcacgtcctcacatcactcgctaatttattcgtagcaacggccggaccacgaatgacgccaacagcgcatatccacaccctatggttaatcagttcggtcgcttaaggcttattataccggttccaagatgataattcggtcattatttaaacttaattgtgattcgatgactgattagccttattttgaataacagggtcaatgacagccaccggtcagccctgagtacggatagctattaataactttgaaataaactaatgtcctaccattttatcttggccaggatgaccaaggcccaaagacaatttattatgcccgcagttggctatgaaaaaagcaccgctaagtttggggtaggaaccgatcctaaacttagcgatgcgacttaactctgttcgcgattgctgcgccaactaacgatcaattaccagtttagccgcgagagctcatccatcattgctgaacgccgcggatattgttgctgccaatcatgtacaatcgcctgcacggtcgatttaccagccgggtaagcgagcatccgttccaatatgccaactaattgttgatacttccgccgagttccagtagtagtagccattttccgaacttcatgatcatatttcgctaacagcagatctgaaaaacgtggtttcaataacggctcataggtccgtaaatcccagagtccgtccgcggccacgaccgcttttaatagcgggttcaataagttttcttgcacatacagtggtttcaaatcgacattggaattcttcgcgatcgccgtcaacagttgctcgcgaatcgccggccaatccgtggtcgggtaactctgcttcaactctgaaaatagcatctcatccgctggcgcatattcagtcaacaattgccataattcctgacgatacaattgctgttcacctaattgctgataagcgtcctttagttggcgactaagttccgctaacatgctgggatcgtccgtgaccaactttttaccatcctttagcaattggaccgcgtgcgcctcatcttgatgttgaagacagaactggctataaaacaagcgaacttgcggtatcgccaagttagcgccacaaaatttaataatttgcttatcaggcacatgagccgcagacatcatttgtaaatagtgctttagccatttttttatctgccagtcatagtcccagagatccgggtgtttttgcaccgcacggaaccgcttagcggtatacaccagctttgcatcaataaacgctggcgtcttgaaatatgtgaataataaatcgtcaagcgtatcttcaataatattcaacgacttcgttaattgtttgcataaccaatcaaacacctgctgctgcacatccgcgtcggcttttgttaagacagcttcccacaagtcgtcactagcactcatgatcatcataatctcaccatcggaatcatcaatgtcgacgtggtcgattttaagcatcagatgcgctaagatttgaaataccaaaccatactcgccgtgatcgaccaacggctgcacctcttcttttaggaaagttaaggcctcatcaccgaaatccgtcgccgcgtcataatcgataaagccaccgccatccgcgtttgtgtcaaataaatcatcaacactcgcgagatatttaggtaaatctgtcacaacattagtctcacccatgaccgtccggaacagctggacgagatgcttgtcatgggccaacaccacactcaaaaagtcccggacttgccgatcagtagcccgctcaaccagcttagtggcagtctgttcaagactgtcgcaactagttggtgctttggaaactggatgttgactggcaggtttgtcagccgccgtcgcttggtacaaaacggccgccatgtgcttacaatacggatgactattggcatacggacactcacacgcgccatcgtgaaagtcaccattagcgagagtgattaccacgccatagtcctgcgtgcccgtaaccgttgccgtaatttgtgttttggtccgctttaaatcagtgacatacccctgtaagtaataatcgtacccacgttcagcgattgccgttggaaaatagtcttcccagtccatattgtcactcccgttaactcgtttgtccttaactatactatggtatgacaaattgagtaagacccggcaagcattttctcacaataaaactcaataccgaccctcatttagcatacgccgtgtcatacctttatctgttgaccctaaaaagcttgttttttcaccgtggtttgtggctcattggccgcaccaatccagtgaattctcactgtttaactttccgaccattgccagtgagacgccgttttatcgaaattagttaaattccagttttgtttttttactggcgctataactaataacgccaaataaaatgccttttctatctacgacgacccttacaatatgaagtttatactaataaagcaattgtacaacatcgtatagtcataatttaggcgccaaattaatcccaataaaaaacgctataagatttcacaatcaggcttaatcactaaagcaaaataccactttaaatggacagaaatgtgactgacttatactacgcgccaaatatcaaattaagggtgtctgataattgatgaatttctttgcttgatgggaagtcatttgtttgtaagtaatatcttatcatccctaacatcatgccaccaataacatttatttccaaatctgactttggatgtgtgagagctgcctgtaaatgattacttaaaatatctttaagaccatccattagttgcatcttagcttgtggaattgtcattattgcgtttattggtctgctccaacacatcagtaattgtctaagttccggttctaattgaccaactgcgttacttaagccaattccttgatttatgagtaatcgcttctttttcaatgtctcatcaagccacgttagaatatcttgtagtattgcgtctgtcagtgcaaatttgtcctcataatgtaaatagaaagttttacgactaatcatagatttgagtgcaatatccttgacagtaacgttgtcaaatccattctctatgactaggtcaacaaatgatttgatgataacgtcgtcagttttttttattctaaaatccgtcatatcgattcctccattaccagttttgccaattctgtaaccttatggctcatatggctgccatttgtagccttaagacacaaatcatattaatttgaccatgtttttcatttcaaaattaatataaactacccgtagcataaaaaagggggtagtgaaaatgttcaacgtgtttaagagaaaaagcatctggatcagcatgttagtcgccactatattaatcggattatttgccttcgcacaagttggagctaggagcacagttaaggttcgtcatttaccattagcgttagtagtaaacgataaaggaaaagatgctaagaatgttgttaagaaattacggaaagagagccataagaaaagcgctgaaattaaatgggtcaatgtaacccacacgagtgaactcactaaaggctttgcatccggaaaatactacggggctgttgtcattcattcgggatttactaaagctatcaatcagcaaacagactatttaaaaggtaaaatcataactcagaagctagctgccctggtagttaaaacgccaatggctgctaagacggccccattccaacaacaaaaagccttagcaaattcattaaccaagaagacccccgaacaagcaaaaatctctttatacgtcagtcaaggaagtaatatgacggttgcaactattttgactactgcacttccaaagatgactgatcatctaaatcagaagatttctaacgaatatataaccgttgcaaataagtcaggactaacactatctcctcaggactggtctaaattgcaaacaccaattcacacaactcttatcaaacgcaataaagtttcaactaaagaaataagtggtatggcgccattcttagtaaccatcttctgttggctcggtagtcttattgctagtttactgaactggcgagaccatagtaagaatgagaagaaacgtactgatggccgcctctcattaactagtgtcacaagtcaattaatttcgggtatcgcaattgtcactgcgattgctgtatcagtttacttcttcacaaaagtttgctattctgtgccaattcatgatccaaaacaattcctactgatgattggtggtatatcatttgttttctatctactgcagtcagctgtactcgatttgcttggactaaaaggatggccattactacttattatctggataggttcaatggcagtcattactttcattccgcaaatgctgagtcccttctatcataattatgtttatgatattacgccaattcgctttgcctatgatcttattcttaaccaaatgtatattacagatgcattaatcactggaccttcaatgttgagcttgctgtacattggtatagcttcaatttttgccatgtatgcatctaccctcattaagaaacgaaaaaaagacagcttagcataagacgtacggcttctttaaacctcctgaacccagaaaagacgaatttaaaacatgaatagtggttaaatcaggtggtgtgtccagcatatccctgatttgccactatttaattcaataaatgataatttatctttccaaaaagattttgatgaaagatgaaaggagataaagcaaatgccacaagaacaatatcaactaactgatgctaaattggtaaaacagctatttgatttaattgagactggacaagcacttgaaagtattactgtcacagaactttgcttaaagtcaggagtatctagaaaaactttttatcgtcattattcatccacacaaaaagtcattgagggctttttggataattctgcaaatgactttatcgaaatattgaaagaaacaccaatactttgtttaaatgattttatcgacgctcttttcaaattttggcttggcaacaaaaatcgattacaagttttacaaaattccgactttttctcatacacattacatcggttaactgcactcaaactgttggacattgtcaacttaaccgaaaattctgattggcaacatctcacttcaacccagcaattcaatttttttaatttttgtgctggtggtttatggcgtgtcttaaatactcaaagcatatctatttctgatcttgatacaagtttaattacatcactctttcaatccaaaaattaatacaaaacaactattgtttattggtacaactaagtttgattctggaacagatttgattatctttcttaatttcacactctgctaaaaagaatctacccaatttttttaaattaaaaacgctaatcctgattacgtcgcctggatatataatttttttaaacttcgcactttcaatcgatgtcaaaagtagaaaaagatatcaatatagtagtagatcataaatattcaaattcattatttaccctctttggtttaaacagttcggcatttaaaataatagagtagcgttcaaatcaagaagatgaacgctactctttttatgctagccccagcataagtgatgagttaattccaccgaatgctgccgacgtgctcaaggcaaatcagaccttcttatgtctgttgctcacgttaacacgcgaaatttgacagttttgtcaggtttgttgagccctatatttgtgggcaccagctaattcatgaccacttcaaccactcctgtaggctccaccatgtgtcctgtaaatttcttagtagaactggttaacggtattcttttaatacagcccgaaaccaatttgacagttttgctgccagcaactgtagccatgcgcctcattctaaaatgacagtctataaattcaatcccctcaatttttccaattcacttctttaaataccatacccttcagtgtccatctgtgcccctttagtatggtctgaaaattttaacgggtctgcaaaagtcacccttctgtcaatttctttgaaagtattaggaacaacaatcattctttctcgttcaaaaggatccatgtaaaacgtgtatcgcacgtatcacacatcatggtattttcttttaatacagataccaaaacgtagctaccgcatattgacctagaatatcttcccgcatgcactgtctgtaagcttttgcatagctacgtttatttgagaagttatgcttattcatctgcttaccttcttgcaagatatgaattattgactagaactgcacttgtactttttttaaaataacataaaacagataatatccgaactatttcagaatataaattaggataagtaattaaaggaaaaagcagaaaaaatttctacttttcaatatattgttcaatggccattattatttgttggttctgtggtaagtccgaatgttccgctccaacacccgaaacagttatttgcgtataatgcttaacttgcttttggtaaatatagcgacccgccaatacgctgtacaacggaactaagccgtcattgctataactttgagtgccagctaaagaatacatatcaattgagtttggaatatattttctgtttgcaatcaagttttctaacaactcagtctcacttctaacagaagaatcgttcaaattgtacggtgcagcaatagtcataaccttttgtacagttagataatggctagtcaaattatgttcaagtgcatacgtgataatcagcccaccattcgaatggccaattaatgaaatctttcgaaattcatattgttgtgatatatattttaaggcgtattttaaccagatagcttgtttctttatatttttaaaaccatctttattatcttcaaaagcaataacaataaagggttgtctttcacctttttttattgcaccactataggaaattgtataattcttatgcactaacactcttaacaaagaatgaggtgttttttcccttttattaatgtctcttataagcggatcaaatctatattgtgtcgcattacttcctggaaccaaaactatgggttcagtaactgagtttcgttgaatcttcaaatttgaaatattctgtttagtccatttatcggacaaaaaaattaacgtcataaggaagcataataggcctattgaaataataattttttttgagattcgcaagttaatcactccgtctattatcctctagactcacaaattcaaaatttatcttttaaaagaagatctaattttcgcatgctctagattaattagtctcatctctgctttaacaaacggtaaatatataaaacaagagacaactaagcaaagaagtgctaatagtagggtcggaatgttgcccccagtggcaataaaagctttcaacagtcctggcgtaccattaggcactggataaacaggcgctgggacaatattgtactttaaaaacggataagcaatgactgtcgttactaaaggactcattataaaaggaattagataaataggcatatacatgattggaaagccaaccatcactggctctgagaagttaaaaaacgtcggtatgaacgaccaagtcaataaccttttcaaatgttgattttttcctatgatgagcacgacaattatcaatgcgagtaacatgccatcgccacccaaatgggcaaaacaagaatataacgtcgagtaagcagttggatgaacagcagcaacaggatgtgcaaatttcaaagcacgatttaaatttaccaattgcgctcgggtactaaaactaaaaagaaaatccgcattaatccccataaatttactaatacttcttagaaaaagtattagtaacactggtatcaaactgtagtgattatcggttagggctgtttgaattatgctatgcagatgagcgtttattccatttgaatcaatttcaaaatttaatatttttaaaattaaaacacaaaaaatgatacagagaataggcttgatgtttgtcaatgtcgcaattaaagcgttttgataatcattatcgtccttattgacttcgactctaaaaaaatcaaaacatttactaactcctaggcccgtcagcaaagcaaaagtaacaccatgaattagaaaaatcaattcatggttctggcctaacttaatgctcaaaataataaaagagaatgcagccattgcaccacaagctatattattatctaaagatttggtagattgtaaaattannnnnnnnnngttttaagacggaccctagttctgtcgacaatatatttcatactttaatagaatttattataaaatatcgaaatggaatattacacgattggctaccgcaaaatccctgaaaatggcacttattcaatacaagttagtttcttatctttgtttaattcaaaaataaacttgcaaaccagactcctcttaaagatacacgttaagattagatatacatgttgtttttaaatttctaagattttagtaaagtgcaaaaagatttagtttttaaaatttagacagtcataacgtgtcgtcacgttatttcgcccgcgcaattcgaatttgcacatggttacccatgcgctgaataatttgataatagttatgctcgtcaacataaccaatttcaccctgattaccggtgtgaccgcttgacaattcacgtgcaattgcttaaacagcactggaacgattcaaataagcaggccagttggtgccccttcactgtggtcgtaatccgccgtgcgactaggttattttgcaaattactatgattagaagatttaattctaactgactgcgatcgtctcaactgatttacgctttgaccacatactgataatcctaatacacccatcaatagattaaaaaacactaataacagggcgtaactttaaaaacactaaagtcatgccctgttattaattggccttatataacgatgcgacttatcacgccactctttttaatttgtttgttaccacgattattaattatcctgtttatttaactgcttcaaccaagtcgccgttgcaagtaggcccacaactgctcgaccgaagtaaacacgatctgatcgccggcttcaacaattggctgattaggatcccacgccgccgtcaaacattgcaccccggccgtatcagctgcttcaaaatctgagcgagtatcgccaacgtacaagagttccgcggcgtctaacgacttagtgcgcatcaattgtcgcagattgtcagctttattaggttgacaatcagaaccatacaaccgcgtggagaaataggacgtcaggccagtcacgtccaaggaaatttgacaactcttagccgccttacccgtaatcagagctagcgccaccccttgctgctgcaacagttctaaaagtgtgacgattcccggatacggtgctgacacccgtaaatgtgcgcgagcgtattcttgataaaaggcggccaaagcgaccggccaccgttgaccagccactgctttgaccatcccaacctcatttagcccaaacgtctggacgatagcttgcttggtcagttcgtgctcaacgtacggtgcaacgctacgacgaaagacgtcaatcaccattggaatcgtcggcgcgagcgtgccgtcaaagtcaaaggcgatcatcttaagcatgcggttcaccttgattaatctgccgaatcacacgacaaggattgcctaccgccaacgaattagctggaatgtctttgacgaccacactaccggcaccaatcacggatccccgaccaattgtcacgccgggaataataatcacgccaccgccaatccaacagccatcctcaattgtgactggccgcgctaacgtctggcaaaaatactgatcactatctggctgccagtccgcacgtaaacgttcatgcagttcgaccggatgggtagccgtataaatttgaacatttgaggcaatcaagacattattgccaatggtaatccgattacagtcgatcaaggtacagttcatattgattgaaacattctgaccaatcgaaatattacacccgtagtcacaaataaatgggctccccaccgaaacattcgatccaatcttggcaaacatagcctgcaatatcgtacgtttctcacttttttggtcataggcgagctggttatactggcttaaaagttgccgtgtacgccgttttagctctaaaaatactggtgcgtgtgcatcataggtctgaccgctcaaactccgctgtcgttcatccatcattaagcacccctttcacttccaagcttaaaaaacgaatcgttactattcaagtcacgattcgtttctttagttatagtcgtttcgctaaggtctcaatcacatagaccacggggacctgggtcgttatattataattaccattaattctctggtgagccaattgatatgaaaaattccaatcggaaagcttcgctagcgtggattgggactggttagtaatgcttaagactgcgcaccggcgttgttgaaaatgctgaacaagtgcaattagttctggggtttcgccactctcagataacgcaaaaacgaccgtatcgtgaatctcaaaagtattcactggataattactatcctcaagtccaaacgcaaccttaccagcgttggtaaaacagcgcgcggcatagcgggccaaacttcctgaggaaccaatgccgacaaaaataaccagcgtggctcgacgcaaatacgtgagcgctggcatcaacttacgttcatacgcgctagaattagtttttgcaaaaaagtgtgctagctcactgacgtcgctcttgggctcgtaggtggacaactgttgttgttcacttttaagagcccgtttaaaatcacgataaccttcgaacccatttttaagacaaaaacgcaaaatcgtcgaggtcgacacgtgcaactcgtgagctaactcacgaatgctcatgtagccgaccctatccatattattaataacgtacctgtaaatttccacatcagtttcattatatttttcgagctgctcataactaaacatccgccactaccccccactccaataatccgttgcttggtcaccataatgacctggtttgttcgaccctcattagtcatacaatcgattggacgcgcaactactatcaatagcctactataatcagccactctgatcgcgctagcaaacgaccaacaccgttaccagtaatcagtctttatctatttaagcgcgaataccccgtcattacaagttggtagcaaccaaaaaactaggctaatcactgacaaacgtcagctgactaccccagtttctttagcgtcaattttaaaaatgcgaactcgccagtgcctgtccatcagactgccccactttaatgtgtgggccataaaaaatcaatcagtaaccggtcgacctgcgcattttcatgtaactggctgtgttgcgcatgtttcccagtaatcttaacctcgcgataagaacgcgcacgcgccgcaactaagtaccgtaaagagcgtgatgaagcgttactgacggacccatccgaatgcgtcccatcgcccttatcaccataaatattaaggacccgtacttgctgacgtggataaacccgccgtaatcctaataactggcggtaggccggtcgcaatttattcggtcgtcccgcagcgttcaacgtcatctggttagggctgtcgtccatgcctaaaataccattgaaatgtccagcaattgcgacttgttgcctgagctgcggcaaccgctcattttgcgcattcgccaatagataataggtaatcgccatattacccatggaatgaccaaccatgttaaacgacgtgatgccataagttcgttggagcgccaccaccacattttttgcccagcggcccacggttggataatctgaagaccggttattagcaaagttcacttcgacaattggtcgataatcacctgatctaaagtggcctttcaaagtcaccgtcccgtttttagcaaccatcgcgcgtacaatagtttttgttttgccggctttaacgatagcatctgccatgtgcgtctcagcatggtaactactgccccacccatggaaaaacagtgttggaatgtagcgatgcctctgagtcgtaaccggtttagtcaccccggtcgtctctgcacgaccacaaccaactaataataacagcaggcctgctatcagcccccataatcgtattcttttcaataactttcccctgaattctatttaataatctattcactgttagttcgtcatttaaatttgtgctaccccgcatcggcgtgcatgtcgtctgagcgttaacgcttattttagcattcaattaaggctcatgacaggaattacaaccaattaggccgatcacccgccgtaccaggtttatcaacccctaaactgacacgctgataattttcaggatgcaccattaatttaaagactaaatcggcaacactcgctcgcgatacctcagttcctttgaaaggttctgcgccgattgtcagttcataatcaatttcggcagcatccgttagccaggctggtcggatctccgtataaaccagtttggaagcactaagcaacctcgctgcttctcgaaaaccgggtaggaaatcggcaatggcttgttcgttccacgcgccaaattttcctggcacctcatgatgggcgccgagtgcgctaatgaagatcaaccgttgccgctgagttcgggccattgcggccaaaatgctcttcgtctgggctgctagatcagtcccaccaacattggaatagactatgtccaccggtgccattgctgtggcaagttcatccgtatcaagcacgttgccatcaatcagcgtgacccgtggttgctcccgatactgggctaaacgttccgctcgacgtaggaacaataccagttcatcgtcagtttctgctaataaccgttgcgtcagcttcctggcaatcccaccattagcaccaataatcattattttagtcatttctattcacctttcttagatattcgtggcatcacttggaccgtcgcctgccgcggtccacttgctagcatcggcattaaatacggactaccggcatatttttgtcgataagcttggtcaatctggttatttaactgttcatcacaaatgggcacaaaattcaccagatgattgctctcggccaagtgaatccggccagccctttgggttacggccgatcgataccagcgtgagcgcggaccgttccaagcacggataaatagttgctgcactaccacgaccgaccaaatccaggtcggtgtcccgtatgtctgcccatcactgtaaaatggggagacttgaaaatcatccgccgtgctaaaagcggctaactgtgctctggaccactgcatcgtggttacagtggttgacactacgggctgattactttttttcatcgttaacattcctccattctggcaaaatagtggtgcttaattcagagcacttcggttaaatggtgccctgccttgatgcttgacacgttattctctgaataaccaactattctgcactaacctcaagtttcatcttaaagcttgacagcaaccatgtcgaatgcttatatggtatttaaaattatacttaattgtaatagaaagaagtgctttagatggaattacgagttctacgttattttcaagcagtggtcgccgagttaaatatcagtcgggctgctgaacgcttacacgtctcgcagccaacaatttcacgacaattaaaggatttagaggatgagctgggcgtgaccctatttgaacgcaatggccgtcatatcagtctcacgagtagtggtgaatactttgccacgcaggcgaaccaaatcatcgccttagccgataagacgcttgccaacattaatacagccaaagaaatcagtggcacgattgaattagggagtgccgagatgcgcagttttttgacgattgctcagtcgattaagaaactacaacaacagtatccgaaaatcaggatcaatgtgacgagtagtaatgcgaatcagattcgaaccaacctcaaaaccgggaactttgactttggaatcgtcacggaaccaactgacaaacacgacttaaactttatccatctgcccggcgaaagtcgctggggattactggttccgcggcattcgccgctagctgaccatgattacattagcttagctgatcttgaaggccaaaagatcattgtttctgcacaacacggtacgatcaatcaacttcaggattggtatggtgaaagcacgcccaaattcaccatcgtcgccacttataatttactctataatgcctcgttactagtttctgcgggcgtcgggtacgcgttagggattgatggcatcatcaatacgaaccaatccgatttgattttcatcccactaacacctcgaataaccgcccgcactagcctagtctggactaagggacaacgcttgtcggaagccgccaaaacctttttaacgcaactggcgacagacctgcagcaacaaatacctactgactaacagtatcgactcagctctcaccaatcaccacaacacactacccaattgatggctgctgaagacgacgcgcatctaattcacgctaattcgaactaaataattgaattgagcacaactaaaatgctaagctaggttattcagtttcagggaggaattatttaaaatgaaagcagtcattattaatcagtacggtgggcccgaagaactccagatggccactatcgaacgtcccagcattgatcaggacgaggtcttagtcgccgttcaggcaacgagtatcaaccccatcgattggaaagctcgtcaagggttgcttaaaggcatgtttgactggaaaatgccagttgtccttggttgggacgtcgctgggaccattgttgaggctggcgcggccgtgaccaactttaaggttggtgatgaagtctttgcccgcccagacatttatgcggatggccggcgcgggacctacgctgaatatgccgcagtcaaagaagacaagttagcactaaaaccagccagtctttcttttgaacaagccgccgctttgccgttagcggggctaactgcttaccaagtcattcatgaccaattaaagattcaagctggcgagaaagtcttaattcaagccggtgctggcggggttggtttaaatgccatccagattgctaagtacctcggtgccgaggttgcgactactgcgagcgccaatcaccatacgctgttgaagcaaatcggcgctgaccacgtcattgattaccacacgacggctattcaagatgtccttacagactacgatgccgtctttgataccattgacgccattgatgagggcttggcaatcttaaagccaactggccgactcgtgacgattgatgggcaaccaacggcggctcaaaaatcccaaggtcccactgtctccagctggtggttacaacccaacggccgggagttagccatcttggggcagctcgccgttgaaggacacttacaagtcatcatcgaccaagtctttccgtttagtacggctggtctccaagccgcccaccggtatagcgaaaacagtcacagtgctggtaagctcatcatcaacgtcggcactgaagcttaatacggtatcggctccagcctcagccaattgaccaatcgccacattgactgtcaaacgacgcattaaagccttaaaagggcgcttcaagaatccactacgaattcctgaagcgcccttttttaagccccatcgcccgaataacgctagttgtcacccctgcattttcagccgcttgtcccatctgtgcctcggcgtgatacctattaccgccaccgtggaaaaataacgtaggcgtatttgactgtacatacttcatgcggtgttgttgtgccatacatccactgagccccagtactagcaaaaccactagcaaccccgacagccatttcacttttacttgcatgtcctgatccccacctttgattggaacctattatacagggttcctgtcagcgtaagtcaagctttttcaacaattatgggatgacgaacagtgctttcatcatttggatggcataaaaacagacttgggaaatgatcccaagtctgtgatttaatgcgcctgtgctgctttacgttaggtcaatgcttatcactactattcgaccagttaccacgagctgtaattcgtggtgtttgattgcctcgctgatattcttgtttgacggctagttgccccaccaaatttaaatagttgaacggttgattaaaattcggctgaaagaacatatccacgtaagccaaatcatcaatcgtattctgattttgaatcattactgagatcgtgtttgcagcttgggcaatgtcgtgacgactccagaattgcgcgccgagaagctgacgattctgataattataaactagttcaatcgtgactttggccgtcgtcggcatataagctggccgccaattgccttgatagacggcgtgtcgtactggtagttctcgtctttgcgcggctagataggtcaacccagttgtggccatcgtgtgatcaaataattgcatggctgaggtggcttgcgttcccatgtacggctgtaaatctccgaaaacattgatccccgccaacgcaccttggcgcagtgcgttagttgccaatggtgtatacgccggctgtcccgtgggattataattgaccacgcaagcatccccagccgcataaatatccgggtcagaggtttgaacataatcattgatcaagatagcaccatggcggtccatagcgacctgcccgcgtaacaattccgtattcggcataaagcccgcgcaaacgacggccagatcaacctcataatcaccctgcgcggtttcaacgatcaactgatcattcgaaccgcttgcgaatccagtcacccgttcattgaggtggatatcgacctggtgatgttgtaagagtttagttgcagcatccgccatttgggggccaagataattattcaaaatatgtgaatgcgaatgaaataacatgacttgttggtccatactagcatagctttccgctaactcggtccccatatatccggccccaacaattgcaacgcgttggttggcctgtagagattgataaagttgttccgcctgctcgtagtttttgcacagtaatactttctcatgatcgatacccataattggtggcacaataactgatgaaccagttgccataatcagcttatcataagtgtcatcaaagacttcgccagtctgcatattggcgacctgcaccgttttatggcccgtatcaattcgtaaaacattatggcgggtcttaacttgagcgcctaactgcttcaagtcagacggcgaggtgtaaaacatgtcttccaggtgttggatgacacccgttaagtacaaataaatcccactcgaaacaaacgaaacgttatcattccgctcgtaaatcgtcaccgccgtctccggatgacgtgttaaaatttcgcgtgccgctgccgtaccagcgtgggtactaccgatgatcattactttcatcttaccggatcttccattcttccagatttgccacgtaattagtaagtgggctcaacattaaccactgttcaattaattatatcgcgcaccaaatcatttgtatatgtgttgatgaaaacaaacctagttggcccctcgttcaaacagcctagctttacaaccactgattagctttcgccacacgaatcgcttctaatcgattgtgaacccccaatttgctaaaaatggcggataagtaattacgggtcgtccccgctgacaagtataaattggccgcaatcgtcttcgtgggcaaccccttctcagcttcgaccaaaactgctagttcccgttcggtcaatggattgttgtctgctgacaacatattcgtgactagctcgggcgcatagatggtgcggccggtcatcacagctcgaattgcatcaattaggtcatcactcggactatcttttaacaaatatcccgcgacattggctttaactgctcgttcaaaataacggcgttgcgcaaaagtcgtcaaaactattactttcgtggctagctgcgaactgtccaatagatcagcaacatccaagccggttatccctggcatttcgatatccagaattgcgacatccggttgcagttcttgcaactcctgccaggcgtttatgccgtctactgcgctacccaccacgtgtagatcatcttctaattccagtaattgggtcaaggcagaattcaacatgctttggtcttctgctaagtataaagttatcatgctgactcactactcctttggtaaagttaagatcaactgggtgccgcgccgactactcgtgatggcaaaggtgccctgtttagcttgcaagcgggttcgcatcccggcaatcccgttggcgccctgacgaatcaaggttccacctttaccgtcatctttcagcttaatctgataaatttttgccgtctcgacaaaatcaatccgcacctcgtgcgcgtgtgcgtggcgcatcacattggtcatggcttcaactaacaccgccgcaaaacaactttggaccgttgtcggccacttggttgcctgtgtctcaccagtggtcgtcgtccagacaccaaccgctgctagattacgagtttgggccaataggacttctgtgagcgattgttcatgcaaattattgacgatttcgcgaactaactgtaaattttggcgactggtttgttcgatttcgtccaattctggtgccactttctccggtgctttgacgagtaattttttagctaattccgttttgagtgtaatcattgaaaagctttgtccaagggtatcgtgcaagtcacgcgcgattcgttcacgctcgttacgttccacaattgtttttaatcggcggttagtttggttgagttggcgctgtcgttcaactgaccacgaaaaggtatacgcgagtatgggtgataacaatggaaaaactaagcccatcacgtcaccattatgccacccaaacacaccaggatattgtaaatagtctcgtatacagccaccaattaaaaaggcataataccctaaagcaaaaccataaaattctcgtttaggacgacgaccaagtaaaaagctcacttgccagccgggaaagatgatcataaaattgttagccgcaaataccgcaaacagtcccgtcacaactaactccgctggcatcgtcactgcacgccaatgtggcttctcgacaaccaagatgtacaacacaagaaaaccaccaacaagcaatagccaaagccaatcatgccaagatttaacgggtatgtaagccgcaattgtatacggcaaataggcgagccacacgtagctcgtccattcaatcgtcttcaatttatttttatgatgcgtcaacaacgccattcccccgtttaagtccccgctgaatcacccaactaacaatcactaataggccgcacacccacagcccgataccaagcaaatcgattaattttagtgtaccatgggtgccccagttgaccaacaaatcgttcacataatatgttggcagtcgtttaccaatcacctgtagccagcttggtaataggctaatgggccaccatagaccactaataatggccattggaaaggtaattaaattactagcgacactcaacgtttcggcacgattcaaaaatgagagtccaacgcccataagcaatgtcggtaattgaccaatcagagcaattccaagtatccctagccattgaaccacggttaaatcaacgtggttcacaacgaccgcaatcgcgcctaaaataacgaccgttaacgcattcattcccaaactcatcatgccaatcgaacgatagtacggtactaccccgtgtggcgttaaccgtagccaccgtaatagtccccgttcccgatcatgcattagaatctgggcaatactgaacagcgtactgatcgtcccactataaacgatcatactgcccatataagaccgattaaaaagtgcgatttgagccgttgtgccaccggtaaccattacttttgtaaataacaagtaaaaagctgctggcatcaccaaggcaaaaaactgaaacgctgcgtttcgaataatcaaacgccgtgcatcaaatctcagttgagccattaaaattttcatgctgagactcccttcgtcagatgaacaaaaatatccgtcaatgattcacgactaattgagacttgatgcaactcactgattatgggcatcatcgcttgcagcgtagcgtcaccgtcttcactactcatgcgtagttcgtcgccttgcttagtaaccgcagttactgccgttaaatttgtaaaccgatccgctggcagtctcgtttggcaacgaatctccacttgttggtattgtttttgcaacacggcaaacgagccttgaaagacaaagcgcccgtccttcagcaacataattcgatcagcgatggcttcaatctccggtaggtaatgactggtaatgataatggttttaccagcggccttcaagcgcctaatctgttgccaaaatgtctgttgcgcattggtatccatgccaacggtcggctcgtctaaaaataacaaatcgggatcacctaccagtgccaaagcaaaggtgactcgtcgtaactgtcctccagataacgccgtcaagcgttgctgggctatgtcttgtagtttcaaggtggctaataatgcttgccaatcaaattcaggcagacgttgtgccgcagctagccttaacatatcacgcaccgtcacgccttgaattgtcatatcaccctgcatcattgacccaatctttaatcgcgccgccaggctaccggccgcttgcccgaacaccttgagatggccctgctgaactcgtttgattcctaataacaaatttaacaacgtcgttttgccggccccattttcaccaatcaagccaacaatctcgcccggcatgatcgtcatattaatatcagtcaaaactgactgttgaccataactaaatgcgaccttagttgcttcaatcaacggtgtcattatccccgcctcctttaatgactatagtgtacgccaacgtaatcgggtcgagtagtcgcgtttgtcataatgatcaggtgacaaatgtcattatttcaacagtattgataagttagcataattctttagaaaataacccagacaaaaagtgagcttctggatttacatcaaaagctcatttgaatcacaattaataacgctagttaccgtgctttcaatacccaatgtgccaattgcgaaacgataatgattccaataacaccaatgatacgcaaactcaatggcagtgttcgaccataaatgagccaggcagctaacaccagtaattcaccgccaaaaattacaaatttcattccaacacatccaatccacttttcgctagtatacgagccagccaatacaatgtcgattgatctgccattcctaactgagggtggtcgctgattaactgtgatttcacttcgtttagttgttactcgcctacgtatgtatgtctttaatccgccattctccagttggaaaatgattagtccatcaaaagttcaatacattcaaaggtcattccaaccgttaaattagttttggcactgacaccggctcttatgttaaacttaatcaatcacaacgaaaataaggaggtcgaccattgttaattaagtctttcccgcctgccgagcgaactccgcaattgattagccaattaactcaactctggcgacagtccgtcgacgccagtcaccactttctaacgcccgctgaaatcacaaccattgagcacgaagtccccacagcattacgaaccgttccacaactgctcgttgcagtggatgatcaaaataccccaactggtttcatcggtattgatggttcactagtagccatgctttttatcgccccagccgctagtggcgctggtattggaaccgccttactgcaaactagtattcaggattatggtgccacaacgcttacagtgaatgaacaaaacccacgggcgcgtcaattttatgaacaccgtggtttccaagtcactaatcgccaaccaactgatgatcagggccgtccatatccactattaactatgacttacaactgtgacccattaaacgactgacttgacaaggtctttttttttataaataatagacttgtccactatttataaaaaaggagtgctgactatcgaatattttagtctaactaaatatattgcgggtatttaccgcgaatccaaaaacagcatcaacacccaactacaggcgctgaacattcgggcgaccgaaagtgacttattactggttgtttacgatcacccggcccaaactcaaaaggacttggctgccagtctgatgctcgatcctagtttattagctcgaactgttcgtcaacttgagcaacgccaactcgtcatccggtttcgtgatcctgccgatcagcgtagtctacgaattaacttgacaccggctggtgaacaaattgctatcgccattaagaaaacattgattgactggtggcatgacttcttcactgctcatccagaagtcaacgagcaagtgtttacgaaccaattacaacaagtttacctcaccttacaagagaaaagagattgaaatcgtcattgaaaaaattcattaaacactttggagtcctcgtaattggtatcctgtgcatgtcagctggcgtcgcactctctaaattatccttattaggaacgtccccaatttcaagtattccgaatgtcattagcaatattacggcaattccaattggccagttgacaattgcttttattttcattttagttctactagaagccatcgttttgcgccggcagttctcctggcaaaacttattacaattaattccgggtagcctgttcggttggttcatcgatgcttttgtgcggtttttccatagtcttcctaatcaaacatacatcgagcaactcggacttgtcttaatgggaacggtgctcttatcgttaggtgtctttttagaagtcaattcacacgccattatcatgcctggtgaaggacttccaaacgccatcgcactgatgcatcaactcaagtttgccaaagtcaaagtttataatgatttcattctgattggcatttcactagtcctggcactcagctttactcattctttagcgggggttcgggaaggtaccctcattgcagcctttttaactgggcgactcgtaaatttctttaccgaacatgcaaatcgatttgttgattggatgacaccagccgctgacgcgaacaactaatttccagaattatcaaacaaaaacacggtcactggctagtgatcgtgttttttggcttgtgttcacgccaattcgttagtctgccagtgcccgaattttttcagccactaatgcaggtgaacatcggctatccgttaattgttctcctaattgatttactttggacccacatgctcgttattacatgttgtagtaattgtcgatcattttcatcgctaccaaacgccacttagcgctggatccccagtcgttgcaggtggaccatttattgaccctaatagcaatcaaatcaagattaccttctgtggtatgctgaacagtcatcaacgtctcagttgccagcagttaagtacttaagcgcatactctgcatcttcatcaaccctcaataagataactttaatcacttcatccaatttcggcagtccaactctttgtggcaagtgtcgagaatcaagctagttgaaaatcgacttgagccgcacaatctcagcaaccatccgcaatataactcaatcgctagcaaccatctcagtcacgagctgtaaatcatgcgaccgtattgatgcagctggtttgatttgccgattatctgcaattaacgcctcattggtaacaatcaatagtccgtcctcaaagcccggaatcattggtatcaaatctcgaagcggttcaaaactgattgattttattttgatgctgtcaaaaacactcacttaactaaaattagctaagtgagtgtctcgtcaactaatggccacgatgttgagcacgatgctttgccaaccgctttgctcgtatcaactgagcatggtcatgtcgggcacgacgctgctgccgcttcttcattaccaagttacgctgatgttctaacttcaacatttgcattgctctagtcggtttgaatcgaacgtgatgttgacgacattgtcgtgccgcacgacgatactcgcgaaccaattgctgctgagcaaccgcactagccgtcgtccattgcagcgttgaccaccgatcttgaattaacaacctaatctggggttcactaggattctgcgtcccaaaggtcactcgggcgacttgatacccgtccgtcgaccaacgctcaaaaacaccctgataaaattgttgatcaaaaaacaccgttaatttgcatcggttaatcaaattaacccctccttaatttcactaacgaaattcggacaaccaaggaaggcaggttactgacagccgttgctgcgtctggactaccgaccagaccgtgtttttaatttcgctaataattaatatgtcagattaagtcagtttgtcaaattagcacttatgtatcaatggaataattaatgcacttagttaatccgacatgaatcatgattaaaacgtgacagtcaatcagactcctgctcgtcagcttgggctactgagcactgtcaccctgccgctcccatcggtcaaccactcgaatggctgataattatgcctccagttagcgtggtaagaatccaccgaaaattggtgcaaactcaaactgtttccggtggatccaagccggcagttgctgaattttaaaatcaagacgttttaaccatagttattgctaaataataacgagtacaacaagtaataattaagattatattaaatggtgtaatactacactattacactgtgattaatagtatactttgtttgtaaaataccttgaagtggttattattagccgcttaaggtttagggggattccaatatgaacacaccactactgaccgtcacgcaattaaatcaatacttcagtcaccagcacattttaaaagccctgaccttcaccattcaaaaggggcatatcgtcgccttagttggtgcaaatggtgctggcaaaacgacactgatgaaatcaatcttagggctcacttcctttactggtcagatttatttaaatggtcagtcaattgcgccatgccatcaccaagctttaagcgctgtgggcgccctaattgaatatcccggactctacccattcttgactggccggcaacaactctcactgtttgcaaccggtgccaatcgtaccgcacgcgttaccaaaatcattgaagcacttagcatgcaagcatttgccgatacactaacgaaacactactcactcggtatgcggcaaaaattgggtgtagccttggctttgctcaatcagcccgcactagtcatcttagatgaacccatgaatggtcttgatccacaggccacaaaagaattacgcgatttaattctatgggcgcaagctcaaggcaccacctttttaatttcaagtcatctcctgagtgaactgcaacgggtcgccaatgacgtcttagttcttgatcacgggcaactgatcgccaatatgagcatgccggcgtttcttgcccaacagcgccccacttatgaattagtaactaatcaagatcaacgggcttatcagctattgcgttctgctggataccacctagttgcagcaacaccaattcgtgtcttaataacgcccggatttcagcttaatccattactgcaactacttttgaccaatcagattcagttacagcggattcaaccccacactgaagacttagaatcatccttattaaccatgctgaaaacggtcaaccactaaggaggtcaatctaatgttcacattgttacgacaagaaaatcgaaaattaatgcaccatcgtgtgattcaactgtttattccatttataatgatttttcaattcataattgcgatatatgccgctcactacccacagctactaacgccatatgatgcatttgtaaacaacgactacggctttattccgatactatttttgacaatcacaattggcagcacttatttaacgaatgaacggcaaaatggcacgttacgagcgctactttatcgcagttattcgcggacccaagtcttagtcagcaaatggctcacgatactcggtctgatgattggcttatctggctttagcaccctcatgagtctcggactgaagttgagcttctttcggcgcttacctaattacggtacaatttggcacacttggggtctgaacatgctatcaacaggactgaccctactatttttaatgagtgtcgtcttactattgggcaccctattcaccagttcaacaccagccattctgaccggcatcattgggtactttattgtgaccattttcaatcaactttgtttttatttatacgccaaagtcagctggttaaagtggaatccgctcaacatgatcaatctaggcgagcaaatccaaacaccacagctacaacaattaacccgactaaatctatccacgctgacgattggttatatcgcctatctactgttattcttaacgcttgccaactattcttttcaaacccgtaacgtttaaaagcatccagccggtcaaataagattaatgaccggctggatgctttatcgattaattgttaatttcatcatattagcgtaactggcgcacaacttgccaaaagtaacgactccagcgtggttgataaatccaagcaatcagaccaattaatgttgctgaccaaactactgctacatatgaccaactcgtctgtggtgccagcataacgtcggtaatcaatttagtcagtatgatgctcaaccctatcagcattggtacccgccaagccggtaacaaaatcgcttggcggttacgctccgtggtttgctgggcgctcaaataccgaccaagtatcccgcccaagccccagactagacatccaattgcgatacccaacaaccagtgttgattgaggaacgccaacaaataattaccaggttgaccgaatgaccgtatcaatacaaaccaactgattggtttaacgactgcatagccgacgagcattgccatcaccaggttaggcgtgaccaataacactaatgcagaagcggtcatcaaaatcagtgcaacgagcgtggtactgattacattgccgccccagacccaccaattgaattgcgcgaaataaattccgggaatattctgtaccagcaccagcagaaccattaatttcgccaaactatacgcaatgatcgtcgttaaactatagctcaaaaacgtcgcaccaaaaatagctgctcggcgaaatcctaagctctgtaaccactcattctgatgccggtaacgtggaatggcaatgagtgctatgcccactaaaatactgattccccatagaaaatcatttggttcaacattactcccaacgcgcaaattcgccaataatccccgccgatcagcatgataaacttgtaaatattgattcaagtactgctgtttcgaaggtgctactaagccatctacatcctgatactgttgccgccggtggtcgtatttaagacctgaaattagcatgtcatgattctgatctagcatttgccagtgttgattcattctgaagccagtccacgcccccagtgctataaacaaaatcagcataccaatgagaagtggcgcatgctgccaaataatcaagtgccccaattttttattcatctcacaacttcccccagttgatggtaacgacggccagcacgatagacgagcattaccatcatagtcagcacgattccgaccaattcataccacggcgcaattgttcccatcaaaggcagtagtaggatgtccccaagtgttgagccaatactcaaactaatcaaagcactggcgataaccccattaaatagcgattgttgccgcaatgtggtgatatccgctgaccattgatgacaggccacccaagttaatcctagtagcatcagcaagcccactaatgccatgattgccgctaccccgtagtgaacatgtaaccagatactaggcaacgactgaatgtgaaaccaccgcaaccacatatttgtccgcgttaacattcccgacgcccaacgccaggtcagagtgctgatcaggattgctaaccataaccgctgattaaagctccccaccagccaagcaagcataattaggcacccactgaccatcgtcactgccacactacttcccaagagggcggccccgttacggtattgctgataaacttgggggattgcagccgtgatccagccgtaataaatcacttgacttacaaaaacggtgaccattaatagcagcccgagccgcagctgttgccaccaaatttgccaacgcgtaacacctaacccagccataaactcgaaacggtgtgtgcgacgaccccagaatgcaagcagcaaaccgctgacgagtcccaaaacataatacaaacggttgggttgttgggcccgcactgcctgattgggatccgtagaagtgtattcgccaggccaaaaaaactggtcaagatgttcataataaacatgcaggctaaccgccggacgaccggcaactttataatctttcgggtgtttaacaaaatccgcagcgttgatccgttcaccacgtacactccgggcatgttccacctgccaagtatgtgtcacattaattgccattaataagctcactaacagacacgttgccgtcacaagtcgcacccaaggccgattttgttgccaccataaccgtctcaattttacagttgccattctacacaccaccccaaacagcttgccggtcgcccaatttaactcggaaaacatctgtaatggtcaacggctggacggccatcatcaatggttgagtttgttggagcgcggtctcaattgtcggcgtgtagtccgcaaagtacacttctaagacccgaccgtaaactttaatcagctgtccatgctctttcacaaccgctggtatatgcttatctgcaaaaacaagctgaaacttgcgggccgttgcccgtaaactttctaggtcgtaatcagcaactaattcatgatgttgcaaaaacagcacttggtcgcataaaccgtcaagttcatcaagattatgtgatgaaatcaagaaactgacgccgtgttcggcgacctcctcaaccatataggctacaatccgctcgcgcacgatgatatccaaaccatcaaacggctcatccaaaataatatatggcacgtgactcgctaacgctagcaagatttgaaataacatctgctggccctttgataaccgctggtagtagcttttggttgataaatgctcggccgctaataacgctgttagttgcgattggtcaaagtcatcgtaagccaacgcgtatgtcgttatgatctgtcgcaaccgtcgaccaccaaaaaagtgacgttgtgtatcaatataaaataatttttgccgacagtatggttgctgcaaagtcgactgcccctcaatcactaattcgccttcgtccgccaaatagtgatcagccatcgtccgaaagagcgtcgtctttctaacgccgttccgcccgaccaacccaacgattcgacctggctgccaagtaaaagtaatcccccttaatatttcacgattatcaatccgcttacttaatgctttaacttggatactcatcccgtgactcccccttttgataagccgtggtcacccacgcctgaacttgctgcgcactgattcctaaaaattgtgcttccgttaacagtgattgtaagcgcgtctgaagatcatcaaccgcattcgaatcagttgcaatctgactcgattcactcacaaacgtcccccgaccttttacagtgtacacggctcgctgatgctccaatatttgataagccttactgaccgtgttcggattaaggtgcatttctgacgccattgctcgaattgaaggcaattgatcccctggtcgtaagacttcctgaacgatctgctgcttaatctgcataactaactgttcgtaatacggtgccccattagttgcaaacggcattttatcacctcggtcttgtgtactacgtgtattactacaactagtacactaacatactaatttgagtttgacaactcaacaatcatattcctggcacaaaatgattacctcaaacgtgagtgcgacatcattacagtatgccaaattactgaaaagagtcttaaatttggttgccagttcatcagtgtttgttcatcctattccgacctccgggacccctgctcgcatgacagatgaacggccactcaacttagtgcaattggtcgccgaattcaattactgcttggaacattgaacaaacgttaatgtggtctcagttgtttggaatctcagtcataatatggtgactgagaattaatgaacgaatcacagttcgattatcaaactgacagttactgataaaattgctgtctctaaaatagcaacgaccaagccagcaaaagttggggacatccctgtcagccattcgaataccttcccaactggaaggcatttcggccaatgctcagcactgccagagtgtgtggttcagacggcttgagactgaggattagcccaactaaggcgttgagcggtaaactcatcgcgtcgctacccggaaggctcatcggacccgaacacgtttcgtcaatatggcattaagacgtgggttgcggcttaaatcagtgtccaccacgttttaacatctacataagcaaaaaaaacgcctgaccaatcagcacctttagctggttagtcagacgtcatcatctggtgattattccaagaaatcttttaactgtttactacgtgatgggtggcgtaacttccgtagcgccttggcttcgatttggcggatccgttcacgggtcacaccgaagacttttccaacttcttccagtgtccgggtccgaccatcatcaagtccgaaccgtaagcgtaagacgttttcttcccggtccgtcaaggtatcaaggacaccttccagttgttctttcaacaattcataagccgcggcatccgctggtgaggttgcgtcttggtcttcgatgaagtcacctaagtgtgaatcgtcctcttcaccaattggcgtttccaatgaaacgggttcttgtgcgatcttcaagatttcacgaaccttttccgttggcatgtccatttcagccccaatttcttcaggagttggttcgcgccctaaatcttgtaacagttgccgttgaattcgaattaatttgttaatagtttcgaccatgtgcactggaatccgaatggtccgcgcttggtcagcaattgcccgcgtaattgcttggcgaatccaccaagtcgcgtacgttgagaacttgaatcctttacggtaatcaaacttttcaacggccttcattagccccatgttaccttcttgaatcaaatcaaggaattgcattccccgacccacgtaacgtttggcaatcgaaacgaccaaccgtaagttggcttcggctaattcttgcttggcagattcatcaccttgttcgattcggagtgctaaagcgacttcttcgtcagccgttaataagtcgacacgaccaatttctttcaaatacatccgcacgggatcattgattttaattccagaagccgagccagcgtcactaagttccttcttagaaacttttttgacacttttgaccgctcgagcatcaggatcacctttttcatcaacaacactaatcccagcatcttcaaccttttgtaataatttatcaatgccactagcatctagtttgtaaggcgctgctaatttatctgataattcatcatattgaatgctaccagttttcttatattccttaattaatgctttaacggctttgtcgtattccgtcgttgcttttgcctttgccatgtagtagcctcctatttagtatgcatctaccagctgatcggttgcaataccgagccaaccttaagtatatcattttcacgcctagttatcagctcgttggacctgctgttgttgccgatataggtcaattaatgccaacgttaactgctgaaccaaatcacgattaccgatctgcttggctgccgttaactcggccttcttactgttgatttgttctaccagcggctgttgattcatgatcacattgactagatcagcaatctcttccttggaagattcattggccacgtccataaattccaaactcgtgacgacaggctgtaaatctgaatccgtcataaaatccgtaaagttgcccaaatcaaattgattatgcgttttaaaataagcctccgcatacaccaagatttgttgatacgaatcatgaacaaaatgaaaaccagcaatcgccatcacctgtaaccaaacatcgtggtcattcaacaaacggtacagtaacaaccgctccgctttctctacccgacttaacggaccactgttcgtactgccatccaccgtggctgggggtggccctagcggcgcaggtgctggtggcggagctacttgcggttcatccgagtgaccaccacgtcgaacggcctgctgaccgaccagtgatcgtaactgttgctttaaatcatccttatcaagatcaaactccgccactaattggtttaaatataaatcctgttcgacactagaggacagttgtgctaattgttgcaaaaccgcctgtaaataagtcaattgatcgggcgtgttttgcaagttcaaatcatgttttaaatactgcatttcaaatgcagtgggcgtttgcttaccatcttcaaatacttggacaaacttctcctgcccctgagcacgcaaatactcgtcgggatccatcccatcaggcatttggattacacccagattaaggcgactgttaccacctagcaatttcagagcacgatcagtcgccttttgccccggcatatcgctatcgtaacagacatataaggtgtcggtaacgcgctcaagcatgtaaatctgctcatcagttaagctcgtccccattgatgcgaccccgttctgaataccagaacgataagccgcaatcacatccataaagccttcaaacagcaccaccgacttttgttgtcgaatggggccccgtgctaagtcaaagttaaataatactgaacgcttgttgaacagcttcgtttccggactattcaaatacttaggttcattaggtgattttttgaggattcgacctgagaaagcaatcacccgaccactcgcgtctttaatcggaaacaagacccggtcaacgaagcgatcacgtaagtcacccgcttgattttcaatgaacagtcccgactgccgtagtagttggtagtcggtctggtgttctttaaaaaaatctaacaagagctgattagcaggtgcatagccgataccaaacgttttaatcgtctcatcatccagcccgcgctcgtgcaagtacttaagcgccggttcacccagttcagtattcactaaaatatgttgatacatcttagcgctatccgcgtacaactttaacagatcggcttgttgctgatccttaggtgcggccggttgtgactgcgccgtatagctcgccggcaagtcaatgtgcccaaaatcggccaccttgacgactgcttccggaaaagacaagttttcgagatccataatgaagctgaacacgttgcccccacggccacagctaaaacagtgaaaaatctgcttttgctcattgaccgaaaaggatggcgtgcgctcttcgtgaaagggacacaggccaaataaattcttaccagccttcttcaactgaacgtattgtccaataaaatccgcaatgttgactgctgagcggacttgctcaaccttttcctcgggaattcgattggccactttgccaccccatttctactaactaaagtctgacaaaccaaccaaatcattgccgcaatcaaaagccgcatcacgaaatttggatgcgactttgtgcgtgcaaacttttacagaatatatattaccacaagtttgacagcagtgcaataataagttgcccttattagacatatttgtcaaatttgtttgtcagcaaactaaaaaagaagctacagcgcgcttgctgtaacttcttttgattatccacagtccgtgcttatttaacgattaattgattcaagtcacccatcacgttgatcatttgggcgatcgtcaagagttgctttaagtgattatcccgcaccttttcatccttactcatcaccatcgtctgttcaaagtaatcgacgatcaatggtcgtaaggcggccagggctttgaaacggtcctccatgctcatcgctggggtaaattgcttttgcaattcaagaacagcatcgtacaagtgttgttccgcttcattttcaaataaacttggatcaacagtcaaatcaccggctgccagcttagctttcgccgtgatccgcaacagacgagtaaaggcttcaattgtgtccttaaactgcggatcatcttgatgcgcattcagcacatcggctgctttgaacatttcacggatatcctgacgactccctttgataaccgtatcgacgatatcgtagcgaatcttacggttgttaaaccattgtttgacgcgatccgttaagaaatcagcaactggtgccgtttgcttttcgaagtctaagttgtacgtagcatcattggccactaattccttttgaatatcggcctcgagttgacgaattgggaaatcccaaccttgttcccgtacgatccgtacgattccaaacgcttgacgacgcaaagcaaacggatcattagagccactaggagtcaagccaacggcaaagaagctcgtaatggaatcaactttgtccgcaatagctaacaccgcgccgaccttggacttaggtaagtcgccatcagcgctgattggcatgtaatgctcacgaatagcttgaccgactgctggatcttcacccttcaagacagcatacttgtcacccatgaccccttgtaattcagggaattcgccaaccatccctgtcactaaatcaaatttatagatttgcgctgcccggtggagttggttcttttcagtctcagtcaaaccaaaccgatcagccaaaaaatcactgataaccatgacccgctgcatcttctcatacatcgtcccgattttatcatggaagctaacctttttgagtcgttccacatattcttgaatcgagtgttgttgatcttcatgatagaagaaagctgcatcttctaagcgtgccgtcaatactttttgattacctaaagccacgttttccaagtgatccgtgttcccgtttcgaacggaaacaaagtgtggtaataagttatcctcggcatccgttacgtagaagaaccgttgatgatcacgcatcgaagtaatcaagacttcatccgggatcgttaagtatttggtatcaaaatctcccgcaaatgcagttggatattccaccaagttattaacttcttccaacaagtcttcattaactttgatttgccagtcgcgttcattcgccaaggctgcgatctgttcacgaatcgttgccttacgtttagcggcatccgcaataacttgaacactagctaagtcagcttcatagtccgcagcagtagcaatttcaacgtcatggcccaagaaacggtggcctcgtgaaacacggccagccgcaacgtccagaatttgaaccggcacaacctcgtcatctaataatgacacgatccaacgaatcggccgaatatacttgaaactgtacgtcgaccacttcatcatcgttgggaaattcatcttggtgataacatccttgattccggccgccaacacttcggccgccgttttaccggccgtaaatgtttgtacaaagacatacggggtacccttaacatctttaaagacgatgtcatcagttgacgccccttggcccttagaaaaaccaatcgctgcctttgtccagttgccatccgcatcctgagcaatcttcttagctggaccccgaacttcttttttcacatcagcctgcttgtcagctaagcctaacacctgaaccgttaaccggcgtggtgttgagaaggttttaacatcttcaaaatcaagccgggcatcctttaagaacttgaccattcgttctttaagttgtaacacactcggtgtaacgacgtgggccggcatttcttccaaaccaatttcaagtaaataagttttcgccattatttcgtctcctcctgtgcgtgttttaataacgggaagccacgtttttcacgttgcgccacgaattccttggcaatcgacttcgccatgtttcggattcgatctaaatagccggcacgttccgtgactgaaaccataccgcgagcatccatcaagttgaaggtatgactacatttaagacagtagtcgtacgcggggtgaactaagccgttcttaatttgccgcttggcttccttttcatattcatcaaataacattaataataattcttcgttgctatcttcaaaagcgtacttagaattttcaaattctggttccaagaagatgtcgccgtacttcacgccatcgccccattcaaggtcaaatacggagtttacatcctgaatgtaagatgagagtcgttccaaaccataggtgatttcagaagtgacgggatcaacttcaagaccaccaacttgttggaaatacgtgaattggctgatttccatcccgtcgagccaaacttcccaaccaacaccggcacaacccattgatgggttttcccagttatcttccacgaaacgaatatcgtgttctagcgggttaatgccaagtttttccaagctttgtaagtataaatcctgcacgttttctggtgagggtttcatgaccacttggaattggtggtgttggtacaaccggttggggttctcaccataccgaccatcggcaggccgacgtgaaggttcaacgtacgccgcgttccatggttcgggaccgattgcccgtaagaacgtgtaggggctcatcgttccggcccctttttctgtatcatatgattgcattaacatacaaccttgatccgaccaaaacttttgcaaggttaagataatctcttgcactgataactttttgctcattagtatcctcccaaaattagtgactgaacggctgatggctttgaaacgggggcatcgctattcccagacttatggcacaaaaaaagtcccctgtcgtcgacaataacgacatagggacgattggtttcgcggttccaccctacttctgagtaacctcagcagcttaattacacggtattaaagctccgaaagcgccaattaacaactttgactgaccgtttttcaccatcacggtctcactgtaagtcgaatccgttaaccttctctcatcaacacttaactattcagttcttcatcatcatagctgatggtcgttcgtttgtcaatcctcattcttccggggcgccaacggttggtaccaactgcccatctgatcgatgaagcgtttagatttcaatcgaacgcccactgagttctgatagatttcatccaaaatccggcgtaactccgccgctgtccgcggtttgaccttgatcgaatgaaccttagccaaatccaacacggaaaactgacgtagataaaagatcgctgctggactagcatgcaagcggtggggatccaaatgccagtgctgttgacagagcaaaccgccgtaactttcagaataatctaacggtaaatcacttcgaccgcaaaccgtacaccaacgcaactctggggccaccccaaacggttgcaataactgaatttcgaccacgttagccaccaacgcgggggccacatcttgatcaatcagttgcagcgcactggtcaactgttggtaccaccgccccaccggttgattatctggaaaagcgacgtccattaagttcataacgtacgtggcataagcgttcaaagcaatgtcttgactaatatgttcaagatactgtactgacttgacactattaatatacgagagaccttgatcacgtaaatcaccaacgtattcccccatcgtgaacggcaataactccgccgccattttgaagccacgccgacgcgcaccgcggataaaaaacatcttcttgccatactcggcagttaaaaacttgattagcatatcgcgttcccggtagtcccggcgaaagagcaaaatgccgttaaaattcgtgaccatttgttgggccatccggatcacctagcgattctaatagtcatcttgccgatagccatagctggctagcaagtcttgacggtccttccagttctcttggacttttacccagagctcaaggtagaccttatccccaagtaagtgttcaatatcacgccgagctaacgagccaatcttcttgagcatgctaccacccttaccgatgatgatgcccttttgcgaagaccgttcaataataatcgtggcctgaacgtgaattttttcttcatcttgacgtttgatcgaatcaatcacgaccgccgttgaatggggaacttcttgacgagtcaattcaagaaccttttcacgaatcaattcagaaatgataaaccgctctggatgatccgtaatttggtcggacggataatactgcggtccttccggcaattggcccttcaaggtcgtcagtagttcatcaacgttatttccttcaagcgcggaaattggataaacttccttccacggcaaagcgtctttatactgatccataatctccaagagatgatctggatggacttgatcaattttattaatcactaaataaatcggttgtttaaccgttttaagacgatcgataataaagttatccccggcaccacgccgttcgtccgcattaatcatgaatagtacggcatccacttcacccaaagttgacaaggcggacttgaccataaagtcacctaatcgactatgcggtttgtgaatcccaggggtatcaatgaagaccatctgcgtatccgcagtggtataaattccctggatacggttccgcgtcgtttgggctttgtcagacataatggcgactttttgcccaacgacccgattcaatagtgttgatttaccgacattgggacgaccaataatcgccacaaagccggaatgaaatgcttgttgttctgccataattaattcctttcaatcttgtccaatcgttaaccaattactagtttaaccaactgacaattaagttccaaattttaggtgcaaacaacactaacccaactaagacggcaaaggccgcggcaaacactaccgccccagccgcaatgtccttaatttttttagctaggggactgaaattaggcccagtgatcatatcggacaggttttctgcaatcgtattgttaatttcacataagatgaccagaaaaatcgctaatgctagccacagccattcgttaacgctcaagtgaacccaccagccagcaaacaaggccaccgcccccagtacaaggtgtgttcgcatattacgttcttcaatcacaaccgttttaagcccagtccacgcgtgtagccaggactgccaaaacgagtgatttttgccaacctgtagccgatctggtctatttttcgaggccataagcgtccagaatctggcgttgcaatgtaaacatttcggtttcatccgctggctgaagatgatcatacccatttaaatgtaaaaagccgtgaacgaccaagtaacctagctcgcgcgcctccgaatggttcaaaaaagcggcttgttcgctaaccttatcaactgatatcataatatccccgagatttagtggcatttccgccgccatctccggatccatcacaatcaaatcatcctcgtcatcgtcgtgcatcgcaaaactaataacatcagttggacgattgacaccccgatactgttcattgattttttgaatagcatcgttattcatcagggtcaccgagacctcggtatcatcccgtaactttaacgtctgaccagcaagatcaattaaatcccgaatcaattgcaactgttctggctgcgctcccgttgttgtttggtcgtataattctaaatccataagtgccccctagcgttgttccacacggtcgtacgccgtaataatcttggcaacgaccggatttctgaccacatcatccgccgtaaatttaacgaacgcgacattgctaatgccgcccaaaatctgttcggcttgaatcaagccactcttagtatggtgtggtaaatcaatttgtgagatatcaccattaacaatcatcttggcaccgaaacctagccgcgtcaaaaacatcttcatctgggcattcgtcgtattctgtgcttcatccaagatgacgaacgcatggtcaagcgtccgtccccgcatataagccagcggtgcgatttcgatgataccacgatccattaagcgctgcgtatgttcagcgccataaatatcgtacaacgcatcataaattggccgcaggtacggatcgactttttcctttaaatcaccaggtagaaagccaagactctcaccagcttcaaccgctggccgcgtcaaaatcagcttctcgacatcgccccgttttaaggctgcaattgccatcacaacggcaagataggtcttcccagtcccggctggaccaataccaaacgtaatatcacttttagcaacggcttgcacatactgccgctgaccaaagtttttgacacgaatgggccgtccacgattgtccttaattaaggtctctgaatagaggtctttaaagtaatccaaagtcccccggttgaccatcttaatagcgctaataacatctggcgccccaatctgaataccttgtttaattaaactcgttaaattatctagtactgcttgcgtattatgaacagcaacctcgtcatcactgctgatcgtcatttgatccccaaacacgtgcaattgaacgtgtaacccatcctcaagcaaagctaagtgggcgtcttctggtcctaatagcgcgactgattgggccggatcggcaatgagaaatttttgttcatattttgagttttcggtcaaaaacatggactcctttattgacagatttaatcaccattatttaataatggcacccgcagttagcgtgataaccacgctgatttcagcaggtatttgttagttaatcatagcataaaagcccccatcgaaccagtacaaggacgcctcggcattcgacaacgattttctgaacagcatttttctttcgagcgattaaattggcacgctatcaatcaacgtaagcccagttagatcagtccctgcacccattgctgatacttaatctgaacaaccggtactgcatttctgatcaaccagaagaaacaaaaaaaccggagaaaagtttctccggttaaccgttaattcaataatgatttaactgtttggttgatcagcttgccatccgcctgacccttaagttttggcatcactgcccccatcaccttgccaaagtcacctttaccagtagctccgacttgttgaatggtgtcagcaacaatctgttgaacttcttcgtccgacaattgttttggcatgtactgctcaacaattgcaatttctgctttaacgccgtcgactaaatcttgacgacccgcattttcgaattcacttaatgattcgcgccgttgtttcagttcacgtgagagcacgcttacttcctcatcagccgttaaatcatggccaacattaatttgttcattcatcaatgctgacttaagcatccgtataacgctgagggcttgcttatcgcgtgccttcatcgcagcttttagatcaccattgagtgtatcgattaaactcattggttttccctcctcgttaggtcattagtaatcaatactaattacttgaaacgacgacggttcttacgcttacgtgctgcttcagattttaacttcttcttcacacttggtttttcgtagaattcccgtttgcggtattcttgtaaagtaccactctttgaaacggtacgcttaaagcgacgaagagcatcatcaagagattcgtttttacgaacgactgtttttgccatgttaaattccctccctccgagctcaaaaagtaaccgttaaattatgcatacttacacataacgcaactgttctagtaaattatacataaattgaaaaaggccgtcaaccaaagtttacaatttccttaaaataaatcgttaaaagcaacgtcagttcggacagtaaatcgttttcatcccccgccagctatgctacactaagactattatcgaaccgaaatgaggttattctatgtcagcaattaaagtctttattttatctgattctatcggtgaaacagctcataacgtggccttagctgccgctgcacaattctccgactatgacattcgctatcagcgtttcccatttgtccgcaccgactcactgctccagacggttttgtcgcaggcactgaaggaacacgccgccatctttcatacgtttgtcgatcgccggctcagccaaatcgttaaccaattttgcgaagcgcacgagttgccttattatgacgtcattacaccagctttagatactttttcacagattacgcacgtccaaccgtccaatcaccccggtaccgtacacgcgttaaacaccaactacttcgaccggatcaacgcgatcgaatttgcggttacttacgatgatggtaagaatccgagtggctttttagaggccgacgtggtcttactgggtgtctcccggacctctaagactcccctgtcactctacttagctaatcgtaacctgaaagtcgccaacttgccactagttcctcaggctcaaattcctgacgaaatttggaaagttgatccgaaaaagatttttggcctaactaacgatcctgaaaagttaaacgatattcgccggcagcgaatggtccaatatgggcttaatcccgacaccatgtattccaacacggataaaattaaagccgagttggaatacgccgacaagatcttcaaaaagattgggtgtttagttatcaatgtcgctaataagtcaatcgaagaaaccgccactttaattaccgaaagcttgaatactgacgacactaacaatggctagtatcactaattgccaactcaccgatgccgcctaagttttcctgacaatcagcgcgtgccaccttctaacggtcagcgcgcgcttttttgcatcatttttcttatcattaattaggtcagctactaatcatcagtcgtgtcactcacacgagctcgacaccaccgtcaacgtgcaacacttgcccagtcataaactcattttgcatcaaataaacatacgccgacgcgacttcggcgggcgttgccacgcgtttcaagggattaccagcactgacggtcgcagcctgggccgccaattgtgcgtccgatagttggcgccaaagaccagtcggcgtccaagtcggtgcaactgcattgacgcgatagtcaggcgccaactctacggcaagtccaacgaccatcgtattaatggcttgattgccaacaatcgctccggaggcattatctggccgcccaccagcacccgaagtaaaaatcagcgaaccgtgttggttaagatggtggctggctaattgggccacttgcagatttgcaaaaaatttatcttcaaccgtctgccgaatcgctgcaatcgaattgtccaagaaccccccacccattgcaccacctaacattgagacgacgtggtcaaatgcgggctgagctgcaaaaaaagtttttagttgcgccagattttgtgcgtctaacgccgttccagtcaaatggtctgatgggcctaattgggtgatggcagctgttacgtgcgccgccgtatgacccgataatatggacatcggcgccttcctgtaaggcttggcgagcaattgccatgccgaaacccgaagtaccaccaatcactaatagccgctgttttttcaattgcatcgtcattttcctccttctaaaacaaaaaacgacaaccgactagcgattatcgttcaattctcattaacgttgctgttcaatatcttcaatcaaatgcggattaaactccccggcccgaagcattgcaatctcatacttataaggtggcaattgatgtttcttatcttccccgacatacggcgtttctaaaatcttgctgatgtctggcaattgtggatgatgggcgaccttattcaaagtatcaaagccaatcgttcccataccgatattcgtgtgccggtccttgtgagcaccttgaggattcttagaatcattgagatggatcactttcaaacgatccagcccaatcacatgatcaaattcattcaggacaccgtcgaaatcgtccttaatcgcgtaaccggcatcactagtatggcaagtatcaaaggtaaccgataacttttcattataagtcaccccgtcgatcatctgtgcgagttcttcaaacgtccggccaacttcagttcctttgccagccatcgtttctagcgcgatttgaacgtgctgctctggccgaataaccgcgttcagtcccttgatgatctgcgcaatggcaacatccgctccggcaccaatatgtgctcccggatggagcgttaattgtgttgcgccaacggcatctgcacgctggatctcttgatagagaaagtccgttgcaaactcaaaataacccggctttttcgtattacctaaattaatgatgtatggggcatgtacgacgatctgccggaggtcatgagcctcgattatcggctgtgcttcgtcaattttcagttcgtcaattggtttacgccgtgtattttggggtgcgcccgtatagatcataaatgtgttggcgccgtaacttgccgcctcattggcagatccgagcaacatgtcgggtgccttcatcgaaacatgtgaacctaatctaagcattgtagtcccatccttttcgcaagtttactaattcctgtcataccttaaagttgccggatacatatgataccggcatgatcactcattatccaaataaatctgtcaagttattctaagcggttgtggtcacccgtggataaaagtacgccaaggtccgctcaatcgcatgaccgtcattacgcgtattccataactgattaaactgggttaactgtaacggcgcacccggcattgctaggacatgattcaagtccaccaccgtccggactaatggtcccggcgcccagtccctaaaatcagcttgcaggcccacttcttgctcatagtggtcccagtcaaagacataaaaaacgattttttgacaatttggtaacaacgcgtagtcaaacacaactgaggagtagtcactgaccaaagtattagcgaccgtcaacaattcatcggtactaaactcaggtaccaatgtcactaggtccgggtaacgggcttgcaaatcacgttcctgctcggccaaatggggatgtaacttaataatcaagtgttgatcaggccgcaactttaattgcttaaaatcagccggcaacgcaaattgaacaccggctcgataagtcggcgcatacaaaataacttcctgttgtttaaacgccggatacttctgataaatggccgttgcggtttgcatcacccagtcggacttacaataccgatccgaacgaggatatcccaagacccgcatccgcgtctgtgggacgtgataactcgctgcaaaaatcgttcccatcttctcagaaccaaccacgtaatcagtaatctgatcatacacggtctgaaaccgacgccgatcatctgcgggccgctgtgccgtctgtggatcaccccaaccaaatgttttgaccgcgccagcagcatgccagagttgaatcagtcgttgtggggcctgccgcgtcaagccagcggtaaagccataataattatcaagataaacgtccgctgcccgggtaatgacgggaattcccgtcaaggcaaatcgaactgaatcatgaaacggccgtgtcacaattcccgcctgtgccagttgtgccgccccggtggctgcactcggcaagtaataaacagtcaagcgcccgggaacgcgctggttcaactgctgaataaaatccaaattgtccgcaaagctcatcaaataaatcacctgatcatttttgctaaagtgcgctagccacgatacaactcgcaccagccagacataaattactttcttcacactggccatcctttcatttcatcattaattattggtaaagcgtgccctacgtgacaatcaaaaatgtgccagctcaattacgcttaaaaagttcagattagcgtcaacttacttgagccgtctgccttagtccactaaatataaacaactatttttcaagtctgttccccgttagttgttcattagctctgggtctaactgatatgcacttatgatccagcaataacacaatgcttgtattatataacagatgcccacacttcggctagtcgggtcactattaatagtggtgtaaaagtcgtccccgaacgcctaattaaaaagtgcttgcaaacaagtcccgaaagtcctgtttgcaaacacttttaatctgataaattcatcaaggcttcggttcataaaagtgaccgagaatcttgaccgtatctgaaatgctaacgaaagcgtgcgggtcagattcggccatggccgccttcaactcgcccatttcgtaacgcgtgatgactgtaaataaaatcgttttatcatcatgttgataagcaccttcagcgttgtgcacgatggtaacgccacgacgaatccgattttgaacgctatcaatcaccgttttagggcgactcgtaataatcatcacttgcatcttctgttggcgcgtatacgtcatatccatgacccgaccatttacaaacaacccgagtgcggaataaaaggcatatggccacccgtaaacaaagccagccgcaatgacaatgatcgagttgaacgccatgttgatcgtcccaatactgcgacccgttttacggcgtaacacgataccgataatatcgaggccaccggttgaaatcccatttttgagggccgttccggtcccgaaaccattaacagcacccccaaaaatcgcacaaatgatggggtcatgggtcaaaccaactggggcaatcagtttgatcataatactagatagcgtaacagctaagaacgtatacaacgtaaacttatgcccaatcgatcgccacgcaataataaacattggaacattcaaaataaacagtaacgccgcagttgaaatctgaacgggaagaaacttgctcatcaaactattaatcaattgtgcaagcccagtgattcctgaagaataaatatgccccggcgtccaaaagtagttcatggcaatggaaactaaaatggcgtatataaaagcagttgacgctttcacaacatcacgatggtgtttggataactgctgaaaatcatccatgaattaagtgtgctcctttacgtttttgctttcgttattgtaacacgccgattcgcaaacggccggtcttttgcagtattctgctaaaagtctcacgtttctcagcaaactcccattaatcaatccgactaatttccagaacgagccccgctacgatagttattattagatcacacctatcgcgatgaccagcaactcacgcttagtccactttaggtgcatcggcccactgctcggcgatgaaatcagcgcggccacccgcttcttgttccgcaaataccactggattatttttataaaagcgttggtggcgtgcctcggctggataaaatggtttagcatcctcaatcgccgttacgattggtttactaaatcgttcgctcacctgtaatgcccgtttagacgcttccgcgatccgccgttgttccggaccattcacaaaaatgaccggccgataattatcaccacgatcttgaaattgccccattgcatcggtaggatccgtttgatgccaataaatattgactaattccgtgtaactaatgatatcgggatcaaacgtaattttgacagcttcagtatgacccgtcgtatgcgctttgacgtcttcgtaagtgggatttttcgtgtgtccaccagtataacccgagacaacactgtcgattccgggttgactatcaaaaggctgaaccatgcaccaaaaacatccacccgcaaaaattgctgtttccatgagaattcctccaattaaatattaatataaatttaacactaattaaaaagaacgtccatttctggacgctcttaatatttttattcggttggttcatcatccgttacgggattggtaatattcaaatccaaatcagctaattgctggtcagaaacccgcgatggtgcattggtcattggttctgacgccttggaattcttagggaaggcgatcacttcacgaatgttgtcgttacctgataataacatcgcgaaccggtctaacccgattgctaagccaccatgaggcggaaagcccatgtcaagggcatccagtaagaacccaaattgttcttgggctcgttccttagtgaagtccaatgccttgaacatcttttcttgtaattcgcgggtatgaatccggatcgacccgcccccgagttcataaccattcaagatgatatcatatgattgtgcatgggctttgtgtggatcttcgccatcattcaagtaatgaacatcttcttcattgggcattgtgaatggatggtgagctggtacccagcgctcgatgccttcatcatattcaaacaatggccagtcaacgacccataggtaagcgtattgatcttgatcaatcaagtcaagttccttagcaatcgcggtccgtaagtaacccagcgtgtcagaaactactttgaaactgtcggcagcaaacaataataagtcgcctggtttagcagcagcagcactcgtaatggcttcaaagtcaccatcgttcttgaagaatttcgcaacgggaccactaaagccgtcgtcagtgaccttcatccaagctaagcccttagccccaaaccgtttaacgtactccgtgtacgcatcgatttgctttctagaatattgatcagcaccgccaggaactgcaatcgccttgaccaggccaccattagcgagtgcattatcaaagactttaaaaccggcgttagaaacggccgcgcccatgtctttgagttccataccaaagcgcacatccggcttttcagaaccaaaacggtccatagcttcttgccaagtcatccgcgtaaacggcgtcttgatgtcaacacccttgacgtccttcatgacttgcttaatcaagccttcagtataggactgaatttcctcagccgttaagaaggatgtctccatatcaatctgggtaaattcaggctgacggtcaccccgcaaatcttcatcacggaaacagcgtgcaatttgatagtagcgatcaaaaccggcccccatcagcaattgcttaaagagttgtggtgattgtggtaacgcgtaaaaatgcccttgatagacccgcgaaggcactaagtaatcccgggccccttctggcgtcgacttcgttaagaacggcgtttcaatatcatagaacccgttggcatcaaaatagctatgaactgcttgggtgatgccattacgaattttcaatccacgttgcatttctggccgacgcaagtccaagtaacggtacttcaagcgcaattcatctgatacgttaatatcatcttgaatataaaatggcggggttttcgccttatttaagattttggcatcgtgaatctcaacttcaactttaccagtcttcatgcggtcattaacagcgtcagcattccgattaacaacggttccttgcacttcaatgacgtattcgccccgtaactgatctgctaccgccaaagcatccgctgaaaattcctgactaaagactaattgcacaattccttcacggtcccgtaaatcaataaaaatcaaactcccaaggtcgcggcgtttttgtacccaaccttgtaaagtgaccgtttggcctaaataatcctcattgatgagacccgcatatgtggtccgtttcataaacgcttcctccttataaatcggcaaacttgccgttcacactacttatctaaaacttgatgagcatcttgatagatgtccgccatcgcaaccttggtttcctcaccagtagccatagccttcaagttaacgacctgatcagccagctcggtttcgcccaccgtcatcgtgtaacgggcattcaagcgatcagcactcttgaactgagctttaggcttgcgatccaagtaatcccgttcggccttataaccggctgcccgtaatgcctgtaccagcttcaaagtcgtagcactagcagtgtcgccaattcccacaacatagacgtccaactgatcatcagttggtaccgcaatgttttcagcatccatcaacactaatagtcgttcaacacctaggccaaagccaacacccgaaacttcagggccacctaattccttaaccaatccgttgtaacgacccccagcacagatcgtcgtgtagcccttgcctaacgcttttgagtgggtcataatttcaaaaatcgtatggttataataatctaatccccggaccatcgtggcatcaatctcgtacggaattgctaatgcatctaaatacgtcttagtttgatcaaaatgcgcttgagcttccggagacaagtaatctaaaatcgatggtgcatcggccacaaattgttgatcttccggtgccttactatctaaaacccgcaatggattcttgtgtaaccgttccttggagtcatcactcaattcatcaaagtgtggttccaaataatcaatcaaggcttgtcggtaatcatcacgcgtttgttgatcacccaacgtgttgatgaccagtttcaaatcagtcaagccaaaggttttaagtaagttatagcccattgcaattacttcaacgtctagggcagcactttcactaccaaaagcttccacgcctaattggtggaactcacgtaaccgacctgattggggccgttcataacggaacattggtcccatgtaataaaccttgtatggtttgagaacttgcggaccgtacaacttgttttcaacgaacgcccggacgacgccggcagttccttctgggcggagcgtaatgtgccggtcacccttgtcatgaaaatcgtacatttccttcgttacaatatcagaagtatcccccgctgaacgtgagaagacctcgaagttttcaaacatcggtgtccggatctctttgaattgataagtcttgaagacggcacgagccgttgcttcaacgtattgccacttttcactatcgccaggcaaaatgtcggcggtgcctttaggccgttgatatctcattaatagttcctcccttgattgcaatcgacaaaaaaagcgcccttgattatttaccaagggcgctattagcgcggtaccacctttttgagtactaattgataacgtctgtaatcacaggcggaacgctgccgttcacctcaaaagcgtctcctcattgcgcactatccggaattctcagcactaccggtctctggttatagtggcgtacaatgctcttactttctctgcggtcgattgattaatatatggttaaagttacacgaaaatcacttaaaagtcaacgattctagttaaaattatctcaagatttcgtcggtcagctgtttttttggtatactatttgcagcacttcaaattgcaattatcttaaatctagttggtgacagagcatgcaagttttaaaacaattttggcgtcaaatcacagtcacggttatttttatcggcctagtgattggctttgtagtgctattagcgactaataacactgcgactgttaacattgccaacgtcaatattcgtagcggtccaggcatgagttatgcgatcgaggacgctacgtctaagggcaccaaggtccacattatgaaacgcaaaaataattggctatacgtccgttatgcggatcataaattcggctggattgctagttggttagtcaacgaacataacagtcagttgactaaaaccaccaaaatctctgaagccaccatcgttttagatcccggacacggcggttctgattccggggcgctctcgagcaagggcaagatggaaaaaacgtacacgttacgggtcgctaaagctgtagctaaaaagctccggactgctggcgcacacgttgttttaacccgtgattcagatgaatacgtcggcctgagtgcgcgtcccgcaatcgcaaacaagcttcatgcagacgccttcatcagcttccactttgacagctcaccagaaaaaaacacggcttctgggatcacgacctattactatcataagtcaacctcactagcactagccaaggcgttaaacaataacgtctcgaccttgccaattcctagtaaaggaacggacttcggtgactttctggtcattcgtgataattcacgaccatccgtattgatggaactgggttatattaatgataagtcggacttcaagacgatcagttctaaaaagtaccctcaagaagtagcgcacgcggtttacgccggattgagtacctacttcgccaatcaataataatgcagtcagcatgaagtctttgaaagtggccgttattccagtgactgggataacggccacttttcgcgactactcaatcgatgaatcgcatatcaactgacgcggtttacctaaataaccgtctatttgcctgcactttagctccgtaccggacgtctaacctcatttcacactcttacggatcagcgccactaattgttaataacaattaattgcgttacagtgatggtaaccgtatttaacatcgcagcaaggaggagttaacatgcacttaacaaaagcttggctcgcacaactaccactcactgacattcagcaagtgcaaccagtgagcggtggcgacatcaacgcggcctttcaaatcatcacccttcatcatcaccaatattttttaaaggtccagccgcacaacgacgttactttctttgaccacgaagtcgctggattgcgactacttggtgcagtgactaagacaccgcgtgtcatcgccagtggcacgattgccacggacggctatctcttattagattggctagcgaccgggactggcagtcaatccgcactgggagcggctgtcgccaaagttcatcatcaacaccacgcccaatttggtcttgaccacgacttcacagctggcaagttaccgaaaattaatcattggcagactgattgggcaactttctatacacaacaacgtttagatgtattagtcaatttggctaaggagaaccatttatggtcagaaacgcgtgaaatacattatcaccgcttacgacaacaactgttgcaagattcccacatgcatacggtaaaaccaagcctgttacatggcgatttgtggtcaggtaattacttatttgacacgaccggtacacccgttttgatcgatcccgacgtgttttacggtgaccgagagatggatctggccatgacgacgatttttggtggttttgatgctgatttttatcaggcctaccaagcggcctacccggttgcgcccggtatgcaagaccgcctaccaagctaccaactctattatttactggcccacctgaacctgtttggtgaaacatacggaccagccgttgaccgaatcctctcaatgagctgtacgggtcgcgaggcttgtatataattttttagctacaatcatcagttatcacaatatttcgagtgtctagactagtcgacaaaggtcaataagtcgtttaaatccgtaacttgaacttccggggcactagtcaccgtaatcaggcggtcaatatcaaataaatatccggtaatcccagcattgtgaccggcatcgatgtccaagttgcgatcacccaccataacggcgcgttgacagtcgacctggtgtttattcaataaataattcaacgcagctggatcaggtttacgtgggaatggctgagcagccgtgaccgcatctgtgaaatattgggctaaacccgctcgttgtaaataggcttgtgcgctttcgtcacgatgggtcatcaaataattgtgaccaccaactgcgataactttttcaagcaccgcttgagcacccgcaaaggcggccggtgcatgctgtaattgtggctcccaacgttgatagcccgcccgtaaatcatgccaatcccaaccatactgagccgcaaccattctttccgcataaccaactgactgttgccgcatcagctggtacgttgtatcagccggaatagtcccacctaactcggcaactgctttttggaaagcttggaccatggctggataagtatctaacaaggttccatcgaggtcccataaaaactcacgcatctcattcactcccgctaataattgtaatagccaaaaagctgaaagtaccggattggtctttcagcttttacttcaacgttgatcagtatcataacaaatcgtgaccggcccatcgttaaccaaggaaacttgcatatcggcaccaaattcaccagtcgcaacggtcacgccactggcagctaattgctgattaaatgtatcatacaatttgctagccaattcaggattacccgccgctgtaaaacttggtcgattaccatggcgcgtctccgcgtataacgtaaactgcgatatcgacaagattgctccaccgacttgttgaatattcaaattcatttttccatctgcgtcactaaaaacgcggaggtttaaaatcttatgcgcgatgtaatccaattcggcttgaccatcgccatcttgaaaaccaaccaataggacgaaaccgtggtcaatcgtgccccgaactttcccatcaatactaacttgtgcctgctgtgaccgctgaacaatgactcgcatagaagcctcctaaaacattttccgttcgacaacgtaaaggtcctgaacatttttcagactgtcaatgattcgttggagatgttccaagttgcgaacccccaacgaaacactaataatgaccatcttgttgtgatcgaccttaccgttgacattggtcaaaaatttcgtgtgattattgataactttcaacacatcgttgagcatgccattacggttataaccttgaatttccaaatcagaattgtagttcgttcggtcaccctcgggattctcccactgaacatcaatcaaccgttcaccatttgcttctgcgctcttaacgttcggacaatcaacacggtgaaccgaaacaccgcgccccttcgtaatataaccaacaatctcatcacccggaattggagaacagcaatgacttagacgtacgagtaagttgtcgacgccttgaataatcaccccaccagaagatgagaccttttgccgcttccgatcctgcttctcctgatcctcattatgatgatctttcgatttcttcttcgctggcgcttccgtagagtctgccaaaatggcctcctcacgttcacgctgccgattagcctcgcgctgtttacgaacatcactcgttaaccggttagcaatccctaccggttggacgtcaccaaaccccaaggccgcgaacaaatcatcctcactaccgtagtgcatcttttgagcgaccgccgtcaccttgtccttagtcatgatttcttttggattaaactctaaatcacgtagctgcttctcaagcaaatcacgacccgtaatgatgttttcctcacggtcagcattgcggaagaactgtttgattttattacgggcccgccgcgtatagactaatttctgccaatcacggctaggaccagttgaactagtggacgttaaaatatccacgatatcaccatttttgatttggtaatccaatggaacgatcttgccattgactttcgcaccagtcgtatggttacccacttccgtatggatcgaatatgccatatccagtggtccagcgccctttggtaattctgtcacttcacccttgggcgtaaaagcatagacccggtcactaaagaggtcgcccttgacgccctccataaagtcggcagcgtccttactttcatcctgtagctcaatgatttctttgactaagttcaacttgttgcccgactgagtctcttggacctcgtcgcgtttaccttccttatacgcccagtgtgctgcgaccccgtattcagcgacccggtgcatttcaaacgtccggatctgtatttcgaggggcttaccttcaggaccgaccaccgtggtatgcaaagattgatacatattggccttgggcatcgcaatataatctttaaaacgccccggcatgggcttccattgtgtgtgaatcgcacctaaaactgcataacagtccttgattgaatccacgactacccgaattgccagcagatcgtaaagttggctaaactgtttgtgtttgtcccgcatcttcttataaattgaatagatatgcttcggacgaccataaatttcagcttctggtagttccagatcatggagcgccttttgaatgtcttgaatggcaatctcgatgtacttttcacggtcctcacgccgcgaattcatcaagtggacaatgcgataatactgttgaggattcaaataacgtagtgaaatatcttctagttcccatttaatcgtgctgatccctaatcgatcggcaatgggggcgtaaatttccaacgtttcatttgcaattcgccgctgtttatcgggccgcagatgctgcaatgtccgcatattatgcaagcgatcagctaatttgacaatcatgactcgaatatctttagacatcgccaacagtaatttacggtgattttcagcaagctgttctttgttggacttgtaccgaatcttacccagcttggtgaccccgtcaacaataacggccacgtcatgaccaaacagttcttcaacgtctcctaaagtaacaccagtatcttccacaacgtcgtgtaagaaacccgaagcgacggtttcagggtccatcttcaattcagctaagataccagcaacttgaatcggatgcataatatacggctcaccagattggcgatactgatccttatgcacataagttgcaaaatcacacgcccgtttaactaacgcgacgtgatcactattcatatacttttgaaccatgtccaggacatcctgggcagtccaggtaggttgtttgggcattttatcaccacgacttccacaaagattctatttaataaaaggcacgtgaggttcccacccaacgtgccttgacaaccgttttaacgcaaactcgcgcggggaccagttaacccatatgctaagtaggatatgcctaaatcaactaacgctaagtaatagacatacgttgggaaaaatagatagagcccgacaaaacagcccactgggaatagccagactaaccagcccgtccgttcagtccgacgaatccaccagccaacgactgctgccagcacaaagtcaactacaaagagtagccatacaatctgatgaaaccggctaatactcgtaaatcgtagcaaccatggtatcatcaccccaacgacaagcgcaatcagccaatactggccattaaacttacgaattttttccgtcaaactaactccctcgcttacgctttattgctaaatgactatgattatttattgtacaccaccgaccgcaaaattacactagttcgcaccaaaaagaaacgctacttagtaagtagaggggtgccgtttcggcccgcatgattcgtggacccaggcccactgccgcgataccagcagtttgtaatgtcgccacttcttgtggtgccaagcccccttcaggaccaaaaatcgccagcagtcgttgtggtgcggtcatcgtttttaacgtctgcaccagttggctgctctcaccttgtttggctgattcctcccacgctacgaccccggtatcatatgacacgtgtgctaacaactggtttaaatccgttgcgtagctcacactaggaatcatcgtccggtgtgactgttcagccgcgccctgcgcaattttcgccaagcgggccaacttgcgggcccgcttattcgctgcccatttagccactgcccactgactatcgaaaaacacgaaggcgctcgcacctaattcagtaccacgttgtacgatctgttcgggtttatcgcctttagacaacccacaagcaatagtcactggcaacggcaattcaacatggggcgtcgtaacggccgtgattgtcgctgtagctgttcgaccatcgcttttcaccaaatccgccagcacgacttgatgtgtcgtcgtaacaaattccgcagtgtcccccggttgtgcgcgcatcaccttgacccagtgtttgaccgtctcacccgtgatagtgaacgtttgcccaatcgttgtcgtaatcggtgttgataaaaagtatcgttgcatttcagtcccccactaatcttcagctgttggtagataagccacaataccgtgccagtcacccatttgcgtatgttgtgtaatttggaagcccgcttccttaattgtcgtcatgacgacctggaacttatcatcgatgatgccagaggtaatgaaatagccgccccgttttaagttttgacgggcttgtggtaccaacggaataataatttcagccaaaatgttggcaacgataatatcagcctgcgtgtcaatcccagctagtaaatcattggcagccacgtgaacatctttggcaactggattcaagtccaaattcgtttgagctgatgccacagcgacatcgtcaagatcgtaagcttctactgcaccgacgcccatcgctttggccgcaatactcaataccccggacccagtacccacatcgatcaagtgttcaccaccattgatcacagtttcaagcgcctgcaaacagagcttggttgtcggatgcgttccggtaccaaaagcctgaccaggatctagtcgcaacacaagctcacctgattgcactggttggtactgttcccaacttggcacaatcgtcaaatagcgcgtaacccggacggggtgatagtattttttccaggccgtcgcccagtcttcatccgataaagccgtcatactgacttcattaggtgctggattcaacccaaaatcagtcagctgactaacccgctgcttgatcgttggaatgacttccggtacaaacaccgtctcaggataataagcagaaatcttcgccccactggtaacgtgtggaatcgtcgccaaatcgatgatctcaccataccgatcaggctttaaattctgataatccaaggcatcatcaattttgacgccactggccccggcttccattaaaatgtttgccaccgcttcgacagcttcattagaagtactgaccgttacttcagtccatttcatatctttatattttcctcccatcgaaagctagagcgccaagcgccatcgcttaagactatcacgtttttcttagtaacaattatataacaagcctgattaacttgacaatcacctggtcatccaaccatgatgttcatgatcgatagtccggcgagaaatcttggatacgaatggattgccggccacaaagtaccgcaatggtgccgttgtccattcacccttgttgacaattccaattcgcggagtcgccataacttgttccggttggcgataatgactcaaatccaatgataaggtcgccggttgcagcgtttgtccatttaacgttttatctaacccaagcgcctgcattagcttgcccggtccgttggtcaagttcgcaatgggcactggccgctgctgttgcattcgttcaagccccacatctggttcaattccgcgaatcaagacacattctggcgtaccggcagcttgtgtcacaatattcagtaagcaccaggccctcatttgataaatataaatcgttcccgctgattgccagagtgcgcgattgcgcggcgtttggtggttctggtacgcgtgagctcctgcatcacgggcgccaagatacgcttctgtttctgtgatccaggcggtcaatacaccgctagatgtctgtaggtgcaactgtttacccagtaggctcgccgcaatttcaggtgtcgtacgtgtgcttaaaaatcgttcgattgctgtcataacttgttttactcgcccctaatagaaaacggactagccaccttgctagtccgtcctcatgttcatttaatcattatttgcggtctttttggttagatgcttattcaaatacttaatcatgtcggcttcatgcttaaagatccgcgggtgcttttgcttgtgcaaccgaaccgcgatctcattgattttgattcgcccggtccaagtatgactgtacttaacgaccacccgattgttgcgatggtccttaccgaatttcaacacgtaaacgctgtcgggcaccatcagcggtctaatatatgttttatcgtagtcataatgtattgatcgcagaaactgtttcgtgcgttttaacatgtcgttgatctctccttcacaatgtgaaattgattaaataataaattaatttatcgttagtatattttcatatctagctattattatagcagactttaaacaagtagtgtaccaatttgccattggtttagcaagtatcgaactttaattcttataaatttgctaaccatttcagaattgtttttgccgcatatccgggtatggtaaaatatgattaaattagtaaggttatcaatattagggggaatttactgatgatactcatcgaaagaatttatcgtcgtggtcatgaacagttgacaacggtcgaccaaatcgaaaaatttcaaaccaatgacggttatgtcacatccaacgaagtcctcgcccgcgaaatcggtgcggatagtgaaaactgcttctacaaaaatcaagagggcaaacgcaaaaaagtcgttgcgaccaaggacgatcagggcacttggcatttaaagaccatcggcacaactgacccgactagcgatggcttattgcaactaccgcatatggatgatgtttggggttaattggtgcttcgtttagaagaactgataattagtgttcgtcagttagaactaccatcaaagactcaggtttctgatggtagtttttttatatacatatcgtacggtatacaagcaacgtaattaatagcaattagtatttttattgaattctaatctatcaatgatacttgcattgatataatctaataagcatgctcttttttattgttggcacagtctgacttcaatgtctttggagccaacactcataacaagctagaagtcattaaaaggtagattgcaaatttaatacgaatttttggacaaatttgtnnnnnnnnnnttaattttacaatctaccaaaagtcaacttgaaaaacaccttatttggaggagtcttatatgaaaaaagtagtcactggggctgccattgttgcgtcattatttatattaagcggttgtggtaatagttcaaaaacatctactcaatcaagctcacatcacaaagaaactgcgaccaatgtcaaaaaggaaaaaactattacggttaatcattcgagcattgtcacttctgacaatagcaagttctcagttcaaggaagaacggaagaaaatatcggtgtttatcttctcaataagagtggtcaagttaaggatacggttacaagtgattctaaaggcctatttcattttaatgaagacaacgatgatgcaaagactgtcccatattaccttacaatcgatgatattgacgcagatactgatcctatttccaacgaacctaataaaaataacgttaacaagcttaaggtttataaaaaaataattgttaaaccttcttctgaggccgttaattcttataaatcttcatctagttcggctatggattctatggttgctgccaattcttcatttgacgaatcggtatccaaaaataattctagtgatagttcgtcgtctgctgctaaatctactactcgtagtatccattatgataaagttgacttagaaacatttgcaactgaaactgataaatacatcggtaaaaacgtcgaaactagtggagaagttgcctacattcaaaagaatccagataatacagatatctattatgttgttatcctccctaaagatgaccatgcatcttcaggctactcatacgggactgttacagagatcaatgtggatacctttgatgaaactaacattaatgaaggcgataatattactgtaaaaggtggcgcactcacatctaccataaaattaaatggtaagaccttaaaatctgatattgttgttgattcagtatctgtaaattagaaaattggcccccaacacgggcttttatttaaaagtaaaaaagaacatacgtttggacattaggaggatattatcatgattattcaaaaaattaccggaaaagaacaaaaacaattggagctgcaggacaagttttatcccggaccaggacgctcaaaaactaccggctacatcgtcgatgataaatggtccgtgtacatcacctacgtaccatttacaggctatcacgtttctattggggatcatcgctatggacttgtccgacccaactatatcaccgttgacgctattgcacggttggacctattcccctatcgcaagaactacatgctttattctgctggtagtgaagttgttcattttgacattaaagactgaaaggaagtataaaaatgcgaggatcaattagaagacgtggcaaccgctggtattatgcatatgaaggccccaccatagacggtaaacggcagcgaatcgagcacgttggtggtcggacccgtgaagaagcagaacgggccctgcgcaaagcaattgatgagtttgagcgcggcggtgttgtcatcaagttgacagagatgagtgtagcagactacttcgattattggcacgagaattttgttgtaaagactcttaaatataacacgcaaacgaattatcgtaatattatcaacaattacattaagcccgatatcggcatgtaccgaatgaaatcaattggtccagcatcaattcaaaagttcgtaaatgacctacccacagacaagctctcaaagcacactattgagatcattgtttcagtcttacgtaagggctttaagatggccgtcttcccttaccaattaatcaaagaaaatccagcaaactacattgtaaagcccactaataataatgatgatgaaataacccagcaagctgctcgagataagctcaaaatcatcaatatgggccagttcaagcagatactagcacttgttcctgaatctaaccccttgtatctcccacttattatcagcttcaacactggcttgcgccgtggtgaggtttcaggactcacatgggacaacatcgattttgataacaaaaccttgaccgtgaacaagcaaatgattatgaagaaaaaagaatttgacgttacgtcacccaaaactaaggcaagctatcgtacaattgcagtcggaaattcactgctaactgttttaaagcgtttcagaacttaccagaaggaaaataaagtgcgttacggacaattttactttgatagcccatttgtttgtaccaaacaaaatggtaagccgattacccctagcgtaattaaatactacacaactaaactatcacaggaattagactttccatttaattttcactcattacggcacacacacgcaacgatgctgctagaaaatggagccaagtacaaagaaatacagcaacgccttggtcactcacgtatttcaacaacgctagatatctattcccacgtaaccaataagatgaaacgtgatactgttgatatcttcgaaaatatgttaaaaaacaacagttaaaaagatgatagacactttttcgatatatgtatattttgccaacatcacagtttcaatgttggcaaaatgttggcaaaacggaaaaataaaagagctccgcttacgcggaaccctatcagttcggcttttcgtcttcgtcggttttcagaacagccatgaacgcttcttgcgggatttcgactttaccgacagccttcatacgcttcttaccagctttttgcttttcaagtagcttcatccgccgcgtccggtcaccaccgtacagatgggccgtcacgtccttacggtaagctttaatattcgtccgagcaatgactttagaaccaatcgttgcctgtaccggaatttcaaagttttgccgggggataatcgtcttgagcttggcggcaatctcgcgtccacgcgcaggtgcaaagtcgcgatgtgcgataaaactcagagcatcaacttggtcaccgtttaataagatatcgatcttaacgaggtcactggcacggtagccgtctaaatcataatctaacgaggcatagccgcgcgtgttcgactttaatttatcaaagaagtcaaaaatgatttcggacaacggaatgtgataaaccacgttgacccgattactatccaagtactccatcgtatcaaactcgccccgtttacgctgggctaattccatgaccgcaccaacgtaatcattaggcaccataatctgagctttcacatacggttcacgaatttccttgattgcagacgcctcaggcatttcagccgggttttccacctttttctccgtgccatcagtcatccgcacatgatacgttacggacggcgccgtggtaattagttcaagattaaattcccgttcgaggcgctcctgaatgacgtccatgtgtagcagtcccaggaatccacaccggaacccaaagcccagtgcttgtgatgattccgcttcaaattccaatgcggcatcgttcaattttaatttttccaacgcttcccgtaaatcggtgaatttggcattatcagtcggataaatcccagcgtagaccatcggattcatttcacggtaacccgccaatggcttttcggccggatttttcgcgttcgtgaccgtatcacctactcgggtatcctgaatatccttgatgctagccgtaatgtaaccaacatcccccgccatcaaataatcccgtgctaacggtttcggtgaattaacgccgacttccgtcacttcatattcactaccactgttcatcaaccggatccgatctcctggacgaacgatgccttcatgaatccgaacactcagcaccacgccccgataatcatcatagacggaatcaaacactagggccttgagtggcgcatcaagatccccctgaggagccggaatcttatgcacgatttgctcgagcagatcttcgataccaataccggctttcgctgaagctagaacagcatcttccgcatcaatcccaatgtcatcttcaatttctttgcgcaccttttcaggttcagccgatggcaagtcaatcttgttgatcaccgggacaatttccaagtcatcatcaatggctaaatacacgttggctagcgtctgggcttcgaccccttgcgccgcatccacgactaaaaccgccccttcacaggctgcgaggctccgtgagacttcatacgtgaagtcaacatgtccaggtgtatcgatcaagtggaagatataagtctccccatcctttgcttgatagtgtaactctaccgcattcaatttgatcgtaatcccacgttcacgttccaagtccattgagtccaacacttggtcttgcatctcacgtttggaaatcgtatcagttagttccagaatacgatccgccaacgtcgatttgccgtgatcaatatgggcgacgattgaaaaattccgaatatgttgttgtcggtcttgcattgtcgctttatccattgattttcctactttcttcctaaatcctaatccctacaattataccaagttagtggcacaagcacaatttttctatcagaccgctccagacaccccgctgcgccactgaataaatgacgtaacaaaaaagtacaagccaatatggcctgtactttttagtaggttattcaaaatccttgatttcactgggtttgagtaattgccattcttttgaatagaagtcgtcattaatctgataatgaaccggcttcgtcttcttagtcaagaatggatcaaccttttgatccacggctaaccaaccacgccagccaagatgaatcgtatcagtcatgaagtagtccttaccaccgtcctgggtcaggtccaagacgttattaaacccttgactcttcaactggtactgaatcttcttgtcaaactgagcaatcatcttcattgacagtccggtataagcagaccagcgctgattgattggtggaatgatgaacaagacatcggtgtgtgtctttgcaaactgattcaaaaccagttgaaaatcggcaaattctggtgacttcgtgtaattcaagtgtcgctgtgaatctttgagtcgcttgtaattacgttttaacttcgtgttccaaaattgattgctgatttcaagactgttcgagtccgtttgcgccgcaccgattttaccggctaattggtttaactgattaaagttatatgtcgctggtaacttgttagcttgcgcattgacagtccgtaaatttttgcccgcaattccaaaacgtgagaagaactcatcctcactgccaaggacacgtgccttatagttaatatacgtcatttgtgcgctcgttggtttaaacccagctgccacacgtgccagggcgccttccaaaatgcgatcagaagaacccgatggcatctgtaacaaacgttgagcggcataccggtccattgccgtattctgctcatcctgtaaccaatcaatggtctgcagtggtgagtaatagtacgaaaacgcatctttccgcgttccttgtggcacaaaccattgtggcgaaattacaaagacggccttcttatttgtaatctgctttttcaccgattgcatcgcgaaatactgcgtcaacgactgggtcccccgcgcaccgagtagaaatggtcggtaattgcggtgatattttgttgccagtacggacggatgcattggatcaaatcgtgaccattctgaagaaccaaagaacgggacatagccatcatccagcgcctgtcgtttaactaaccgaccttttaatacgttggctgacaaggaaacggccgcttttttctcagtatccttagaaatatggtttaatccaaatgagaacggtgaaagcagtacggccaataataagacggctgccaaaataattggcccaaaaatcttaaaaaggcgtttggcaacgttcattgcaagttctcaacctttgcaacaatcttagccggtgtatcccattctgaccgttgaaattcagagaccggcacttcgattcctaattgattttgaagttccaataaaagttggacggaacccattgaatctaagattccttcatcaaacaggttaacgtccatgttactggaaacatcttcccccgttaagtctgctaaaattgataaaaccgttgcttttgtatcatccattgtcattacgctcccttattgtaattatattatggccgggctccaaagaataacgtgttcaagaatcctgagaagatcaagaaactgaaacaaacgacgttaaacgttaggaaaatcgcaaagtattccgtaaatttattagacggcaactgcgcttgatgtttcttcttgtaccgtaaccaagcatcgttgacaaccattgctaaaccatggaatagcccataaacgatgtaataccatgtttccccgtgccaaaaccccatgatcaacatattaataacgtatgccacgttggccgttgtgatccggctcttaaagaccttgtgtttcatcataaagaataccaaccgcatgtagatgaaatcacggaaccagaaggacaacgtcatgtgccaacgattccagaagtctttgatgttctttgacttaaacggttgattgaagttcatcggagtttcaacacccatcaggtaactgataccgacggcaaacaaactgtaacccgcaaaatcaaagaataaatccatactatagacgtacatcacaccgactaacgcccatgacatgccgtgagcttgcaaggccgcgtgttcaacgacaggtagcatccgcgtaccaaagatataagccaaaatgaacttatataagaatcccaagaaaatgtagcggacccctttttcaactaacccgagatacttttcacgggtcgggacactatcgtaatccttaacgaaccgccgataccggtcaatcggcccagacgagatcgtcgggaaaaacagcaagaactggccaaacagtaccggatggaattctttaatcaccccatcacgggtctccatgatcatctggaccactttgaaagtcaggtaggaaattcctaagaaaccaataattgaattagcaccatgtgccacggctggtgtgatcttaacgacagctagtggaataatcgctaaaatcacactgacaacgaaaacccagcccttattaggtgaatctggtcgttgtcgatactttgagtacaaccaaactagtgtgatctgatagaccaaatagataattaacgcgatcccagtgcgccacttaacaccgccaaaggtcagcattaagaagataaacgatatcaatgattcataccaatgggatcgccgaccatataacagaccaatcattaacggtaacaacgcgataaagagcagcacaaagtacgttgggttaccatatgggtcaaaagaaatcattctgggttaacctctttaatgatcgacttgacatcaatcttaccgttaggcgttaatggcaagctcgtttgatagacgaaccgttgtggaatcatgtattccatcatcattccttgtaggtcctttttaattgcagtggtcaaagcaaagtcactttcgaagtcattcggctttggtaccacgtacgcaatcatttgcgttactttgtgctctttatcgtattttggaacggcaacggcttgtttaatatgctgttgctgtgctaagaagtgatccacttcttctagttcgatgcggtaaccatgcattttaatttgaaaatcaacgcggccacgataacggaacagaccgtccgcatccatcgtgccaatatcaccagaatgataggcgggttgcccgtctaattcaaagaaagccttggcagttttttcagagttgttcaaataccccttcgaaacggatggtccggcgataatcagttcaccttccgtgccatttggaaccgcctcaccattttcatcaaccacaagtatccgcgtatcagctttggcataaccaattggtagccgatcatactgcgctaatgcggcatccgtaatttcaatttgagttaccgcgacgcaggtttcagttggcccgtacgtattgaagatccgggcatctgggaaccgtttcttgagtgtcgccgccgtcttatgtgtgagttcctcaccacagaacaagaagtgcgtcaaagttggcaagttttcagcattaaactttggttctagcaaacaaatgtccataaatgatggtgttgagacccaaacgttgattggtaacgtcggcaacgcagcaaataattgtttgaaatcatctgtcacggccttcggtaatgcgtatagtgtcccacctaacgctaaggttgggtaaacgtccatcacggataggtcaaatgaatatggtggttgcgacagcgagttcggctggtcaggcaatccgaagtcatcactcaacatccagtcaacgtaactgaccaagttatcatgactaatttggaccccctttggcatcccagtggtaccagaagtaaagataatatagtaattatcatcgccactaacgacatgatccgcttgataatcaacgggagtcgcaaagatagccgccaattgatctggtgtaatcacgggggttgtcccgacaccggttggcaaatcagcaacagcaataacggcagctggcttagcaatctcattaatcattgttaaccgctcatttggtgaatgtgtatcgattggaatatacgcccgacctgacttaacaactcctaagaaagtcgcaatcatttcaaacgtctgaccaccaaacacaataattggatccttggctggtaaatcgagcgtgtcaagatgcgccgccaaggcatctgaataagcttttaattccgcataagtgtgcgttacaccttgcacatcataaaccacgttattgggttgcgtccgtgcataatcatcaatcgttgtaatgatgttcttaatcataattaaaactccccccaaacaatagtgttactgcatccatttttaaaattcgttgtaaataaacttcgcttggttgatcccactataaccgtaaagataaaccaaggcgagcatgacagcaaagtaaaatactgtaagtgcaatgaattgaacgaccggacgttgaaaccagcttttcaactttgcaaacatgccatcacctcctccactaacccaatgtcagttacttaatatcacccttcattaattccgtaaaaatcttgttggctgttgcttgaataccagcagctttgcgatagtagttactcattaatacaacaccagtcttcccatccggtgagaggaagatgctggattcatagccataaccaagtccgtgtgaccgaataccattactcatgttataaacaccaccgccatattcacctgtggctgtgcgcgtgtgcaaaattgcaacgttcttttttgacagcaactgccctttaagaatggcactttcaacggtaaataaatccgcggtactcatataaacttgcccagtacctaactcattggccatttgtgatttgctttctggcattgtttgatcataattcggaagtgtttggtctgcaagcgctcggtaaccagttgtcgcatcttgaccttgaccatgaatcaaaaagcccgtttcattcagattcaacttgtcaataaaatgtgttgtaaagaagtgctgatatgattgaccagttaccttgcgaataatgccagctagcaacagaaaattaacggatgaataattataaattccatttttatctgggtagtaaaaaacattgtgagccgcaaaatcaatcacttgattttctggtaagaattcttttgaaccgctcttcaaacggaaccctgttgtcatatctaacatttggcgaagcgttgtctgacgcccatgctttaaagttggataatacttcgaaatcggatcagtcagcttaactttccccgcctgcaccaactgcataatgccaaccgccgtcattgacttttgaatcgataaaatttgatactttgaattgactttattacgttgatttttagccttgtttgcgtaaccaaaggcacgattataaatgacatggtcattcttaacaactaatgctgaccccacaaaatggcttaggtttaaagccttagtcacttgctcatccgtgttcttattattcgaaaacgttgtctggttaatcttacgactaagctggctattttttaatgccgctttcttattcaatgctttgtcagtttgacgctttttagcaatcgctgcttgccgctctgtatgataaacatagtagccgccaccagcacccacaatcagcagtccaagcaaaactgttactaaaagtttgctttgcttcacaatgattgacctccccattagctatcaattacgaaccgattggtgatattagctacgccgccaataggacgtaagttcaagttatagtgtaacaacctaccgaccaataacggttaggccggctcaaaaagatcaaaatcctgcattttcgttcgctgatacgacatatttgtaacggttttgtaacatcaacgttacgtcccccgtaagctagcagcgtattacttcacctccttgactaattctagcactcactaatccccggacgacaggataacgaaacagtttgcacaaaaaccgtgttactgaaaggtcacttaataaacaggccggagtgcttgattgacactaaaaaaagctgaacaatcctcatcacatttttgtgatgggcatcgcccagctttttgtatatttctggaattagttcgctcggttaaacaccccgaagcttgtcaaataacgaactcttgccattgccagcaactgatttgccgctagctttagcaaaggtcttcaaagcttctttttgacccttgttcaagtgcgttggcgtttcaatattaacggtaacgcgttcatcgccgttgccattgccacgtaatcgtggtgcacctttaccacgtaaccggaaagttgtccccgtctgagtaccagctgggatcttcaacttaacgtccccgtgaaccgttttaacttgaacttcatcaccaagagcggcctgaacgaagtcgatcggcaacttgaagtaaatcgtcgcgccatcccgttcaaagtccttacttggctcaactctgaagataatgaataaatcaccataagggccaccattcgttcccgcttcaccttgattttgaagccgcatttgttggccttcttcaactccagcaggaaccgtcactttgatggaatgactttgttcagtatgaccagagccaccacaagtggcacacttgtccttgatttctttaccagttccatgacaaacgtcacaaacttgttggctcatcattcgaccgagtggcgtattagtctgtacctgaatatagccagcaccatgacatttcgaacaggtcactggtgacgttcctggcttggcaccagagccaccacaagtctcacactgttcctcacgattgtaggtgatggtcgtcttcttaccaaagatcgcatcttcaaacttcagtgtcatctcatactgtaagtctcggccttgttgcggggccgttgggttagaacgccgtgaaccaccagcgccaccaccgaagaaggaactgaaaacatcttcaaagccgccaccgccgccgaagccaccaaagtcttgaccgccgaaaccgccggcgccaccgaagccttgttggccaccagtcgatccgaattgatcatactgtgcccgcttctgggcatcgcctaacgtttcgtacgcttcattgacagctttaaacttttcttccgcgccaggttcatgattcaaatcaggatgatacttcttcgaaagcttgcggtacgccttcttgatttcgtcctgactggcatccttttcaacacccagaaccttatataagtcttgctctgccattgtaacctcctaatgaaccttaattaagtctcattaatactagcatatttaaagcaaaaaggccaaagccacgtggccttggcctttttgttctgccggtgctacttcttatccttgtctttatccaagtcttcgaaatcaccgtcaaccgtgttgtcatcactgcccttggctgagtcggcattgccagcagcattactgtcggcaccgccttgtgcaccctgagcttcttgagcttgttgatacaacttaactgataagtcctgaacgatcttgttcaaatcgtccttcttggccttcatttcgtcaatgttgttatcatcttgagctttcttcaaagcatcacgagcatctttggctttcttaacttcatcttctgaaaccttgccttcaagatctttcaaagtcttgtcggtagtaaagatcaattggtcaacttcgttcttcaagtcaacttcttctttacgtttcttatcggcttcttcgttttccttggcttccttgaccatttgatcaatttcgtcgtcagaaagacccgatgaactcttgatggtaatcttttgttctttattagttcccatatccttagcagatacgttaacgatcccgttcttatcgatgtcaaacttaacttcgatttgaggaacaccacgaggtgcagccggaatatccgttaattggaagcgacctaacgtcttgttatccgctgccattggccgttcaccttggagcacgtgaatgtcaacagctggttggttatcagccgccgtactaaatacttgcgacttgctggttggaatcgtcgtgttacggtcaatcaacttagtgaagaccccacccatggtttcaataccaagtgaaagtggcgtaacatcgagcaaaacaacgtctttaacatcaccagtgatcacaccaccttgaacagcggcccctaaagcaaccgcttcgtcagggttgatagaatggttagattctttgccagtccacttttcaacagcttcttgaacagctggaatccgagttgacccaccattcaagatgacaacgtctaagtcactagccgataaatcagcatccttcaaggcattttcaacaggaatgcgcgtcttttcaactaggtcagcagttaattcattgaacttagcacgtgttaacgtggtttccaagtgcaatgggccactagcaccagcggaaataaatggcaaactaatttgagcttcagaaacacctgaaaggtccttcttagccttttcagcagcatcctttaaccgttgtaaggccatcttgtcttttgataaatcaacaccgttgtcagctttaaagccatcaactaaccagtcgataatcttttggtcaaagtcatcaccaccaaggtgggtatcaccatttgtggataatacttcgaagaccccgtcgcctaattccaagatggaaacatcaaaagtcccaccaccaaggtcatagactaaaatcttttcatctttgtcggtcttatccaaaccataggctaaagctgccgccgttggttcgttaataatccgttcaatgtttaagccggcaatcttaccagcatccttagttgcttgccgttgggcatcattaaagtaagctggaacagtcacaacggccttttcaaccgtgtcacccaagtaatcttcagcaaagcccttgatatattgcaaaatcattgctgagatttgttgtggggtgtagtccttaccttcgatgctaactttgtaaccagcttcacccatgtgacgcttgattgaagctaccgtattcgggttagtgattgcttgccgcttggcaacttcaccaacttgagtttcgccatctttgaatgccacaactgaaggaaccgtccggccaccttcaggagtggtgataatcttaggttcattaccttcaagaaccgctaccgcagagttagtagtcccgaggtcaatcccgataattttattacttgccataaattaacaaacctctttttaatttagtatttttattgattaattactgtgccacaacaaccattgctggacggagggtccggtctttcaataggtaaccccgttgtaagacttgtactaccgtatcagctggatgatcatcatcaactggcaccgtttgaacagcttggtgaatattgggatcaaacttttcgcccgcagccgcaatttcggtgaccccatgttttttcaaagcatcctgtaaatggccatagaccatttcgacacccttcttcaactgttgggccgcttcatcgtcagctggcgttgccaaagcccgttccaagttatccagaactggtaagacatcctttgcaagtgcttgaccgtcatatttcaacagcgccgcttgttcttttttgttgcggttttgcatgttgacgatctccgcctgtgcacgcaataactggtcatctttcgcatctaattgcgctttgagatcagtaatttgttgtgtcggatcgaccgctgtcgtttgctcagcttgatcatcagtcgcactcgtcgctgcctgtgtcgcttcactggcagttgacattgctgctgaatcagttgttgacgcttgtgaatcttccggcgtcgtccgcgttgatttctttgccaatgttttcatctccctgtccgtcactcgtcaaagtaccggtaataatctaataatttgcgggctaattctcgttggaacgcacccatcagtccaatcatccgtgaatacggcatggcggtcggcccgagcaaggcaatcacaccttgtccgtgttgatcaacatcgtaagtcgcggtaattaaactgtagttcttcaacaaatcgttggtgatctcattaccgattcggacttgaatccgttgaccgggtggaccaatcacgttagctaaccggtccgtttggtcgagtaacgagtacaatgactgtaactctttagggctctgctggtccgtatagttgaacaaattcaacttaccaccaacataaaagcgctcggaagctgccttggacaatacactgccaaaaatatctaagaaaccatctggatcttgcaaatactgtgcaagttttaacggaatctcatgcgttaattggcggaggacgtcttgtaacggcaggccaaccagttgatcgtcgatgaaacgaacgaccggttccagctcatcgccggtaatgtcactaggaatagtaaacgtctggttttcaacgtcaccattattcgtcactagaatcgccattacttgatgattccccaacggaacgagtctgaaaccactcaaccgactatctttaagttcaggtcgcaatgtaaaggtcgtgtaacttgtcagttgcgacaagatatccgccgactgagcaacgatctcatcgatcttgtgaaattcaccgcctaatgaatgttgaatcaccttcaagtctttgccgtccaccttttcaggctttaggatatggtcaacatagtaccgataccccttaatcgatggaattcgccctgaagacaaatgcgttttgacgattaatcctaaatcttctagtcgggccatttcattacgaattgtcgctgaactgaccttgatcggtagttcttgaactagcgatttggatccaactggattaccgccctcggtatagtcacggacaatggcctttaaaattaggctttgtcgttcagttaacgtgatcatcacctctttttagcacttaacttaatggagtgctaacacaattactaatataacaaccaccctgatgaaagtcaaggaaagacaaagtatttctagaaaagaatgcttaaattattaggaccccagtcccactatgactggacttatttgaccgtcgccccccaattagcactccttacttacgagtgctaatatacaccctcacccttcacaatgcaagcatggtgcctagcagactactcgcttttctgctgccattactcagcacaccagccacaacaaaaaaatctcaagagttacagactctcgagatttttgactagcctgatgtacattgccaacagacattctagtgaaacctggccttaacggtaatcagctttcaaactaatcaacgttcagctttattaatggcatgatcaatggtttcattatcaaattgttcttgtaagtacgcttcattgtcgattggcaagtgcacatgaaagtcagcaaaatgttgaactttcagcgtcgcttgttcgacttcaaaccccagcaagtgtccacctaattgatggtctttacttagaaagtgtaagtgaaagccaccgaccgtagcgccttggaacaaatgcggtgcgtagtagccaataatcgttccgtcaacatgttcaccggtgaattccggttgtgttgccgttgccgcgactaatgttttgtacggtggctcctgacgaggcgcgactcgcgtcttgacttttgcaaaggtcccatcgacgcgaatagccgcaaacacgttggtcaaacgatagtcatgaaccacttgttgctcgaaatcagtttgtgtgattgcagctaattgcgcactaatatcaggcttttcaaagtgcaccgatgcaaatggtaacgtctcttcgggctgaatttcccgaatttgaccatcctcacgtgcttgataggcgtgacctcctagaataatcacttcaccattgagaccgtctaacgtcccaatacccgtatcaccatgggttaagagttcaccagccgtaatcgtcccgtcaaataatccgggaacaagtaagcctaatgtgccgtgttgaaaaattgttgttgtgtccattcattgtgcctccaaacgatttgattgttgtgcaacttgaatccggggtgtgaccacaaagggatgcgccacataatagtcacgggtgttttgttcatcccgctttaattgcgcaaccaaggcatccgccccagcaaatttaatttcaccgcgcatccggtgcccccaacgcaccgttaaattgtggccataaagatctccttggaaacctaataagtatatttcaaccgtgattggtcggtgatcaccaaacgtgacatttcgtccaactgaggccattcccataacccagcgtgtcccaatctgcaccatcgtcgcgtaaatgccaattccgggaacccgggtattgggcccgtgagcaacgttggccgttggaaagccgagcgttcggccccgcgcttcaccatgaactacttcgccggcagtttcatattgatagcccagtaaccggttagccgtatcgatatctcccgcgtccaaagcgcggcgaatccgcgtggaactgatcttttcagcatctaattccgccttaggaacttcaatgatttcaaaccggttatgaccatagtcattcaaacgctgcatatttgcaatttcagctggcccgtacgtgtaatcaaaaccagcaaccaccgtttgtgcgtgtaatccaacaattaactgatcgacaaacgtttggggtggcatggcaccgaccgtggcatcaaagtgaagtacatataagatgtcaacgccgagctcactcatcaatgccgttttttgatcaattgtcgttaaataacggacttgctgcggatcagtgtgtttaaaaacaactgacggatgctggtcaaacgtcatcaccgctagtttggcgtgttgcgcctgagcggcctggcgtgccgttgcaacgacttgctgatgtccacggtgaacgccgtcaaaaaatcctaaggccaatacgattggtccttcgggaatctgactaaacgccacgggatactttaaattaatcacctgcatgacaaaaactccttaattgaccgcaaacattttgaacggcttgtaccgctgttcgtccggtcgataactatatagacattttaggctgttttggtaaactaacgcaaccatcgtgttcgcatctggatcagtttgttgcccttctgccgccgtaataaaggccccattcttgacccgttgccactgctcatccgttaacgtgactcgcgggtactgacttaaagctttatcaattggcgccaataatgctccggccgttccagcatcgacgtgggccgcgatttcctcaaaggtcacggtttcatctaaagtaaagccgccactctttaatcgggtcaaatcactcatcacagcgggtaccccgagcactttgccgacatccaccgctagcgtgcgaacataagtccctttactacaagcgaccgtaaaatagatcgtctgagtctgggttgccgagtcataggtagatgcctgccgttgcttgaagctgctaattgtgacatgccgttctgggcgctcgacagtttcaccactgcgcgcatagtcatataaacgccgcccatttacttttactgctgaaaacatcggtggaatttgcgtaatggcccccgtcatctgtgccagcgcagcatcaacttggtcacttgtgaacggctctgtgaccgcttggcgcgcaatctcctcaccatctaaatcttcagtagtcgttgcaaatccgagggtaatgctcccttggtattctttgccagaagccactaaaaattgcacaactttagtcgcattcccaatacaaatcggtaaaacgccatccacatttgggtccagtgtccctgaatgacctactttgcgggtctgatagagtcgtcggattttagcgacacagtcaaagctcgtcatcccacgaggtttatataatggtagaatcccgttcaacataaaaaacgccttcaatcatttaaattcggtttctagtggcagccaatcgccgtgccacggattcgatcgttcttaatcgacggttttcagtataccacacctcacaaatatgtaagcggattatcacagaattcaaggccctgagcaccgcaactaagataccccaaatcgacacgctggtccggtgccactgacgaccacgtatgtgcctggcaaagctgtatttaactcattgatccagaaaaccgtgagcttaatccctattagtcaaataaaacgactgaaaaacaagaatcgcacaaattagtccccttatcaaaaggataccgcgcgggaccgtccctaattacgccgatgactttcaacatatgctgccatcaaaaaagcgtgcaacggccttagtgtggctgatgtacgcttattcaatgttatcgtcttaaaatgcaaccggcacgctaaccgcagttgacagctacatggttcttcaagcttggagcgcaactggctgctgattcaaccactgctgaatttgacgggcaatctgctggggtgtcagttgatcggttgcgatcgtcaaatcggccgcatcagcatataaggcttggcgccgctgcttcaacgcaatcagtgcccctgtatccaattcattgacaagtggtcggctagtatcatttttaacacggttaatagtggtttgatcactagccgtcaaccagataactggcaccgcgctttgtttcaggctaattgcattcattgcaatggtcggagtaccaccaccggtcgataaaatcccgggtgtttcgagtgcttggagcaaagtctgatgctccaattgccggaagtacccctctccttgctccgcaaaaatagtcgtaatcgaccgtcccgcccgctgaacaatcaaatcatctaaatcagcatgtttagttgctaacccggccgccaaaagccgaccgaccgttgttttcccactacccataaatccaattaaaattgctcgcattcttaatttctccttacaatctgataacccgcatcagctaacaacgacgatgcttgcgttctcgtctttagatcactaaatgtcagttgcaagacaccatcaatctcttcacgaatctctaaaatatgaatattgactaagctcagctgagcctgtgcgagccgctgagtgacatccgcgagagcgccaacacggtcggggacgttcaaaaacaaatcataaaagtttggtagtcctcccaactgttccggtcccaagtgatcacgcgtcaccttagctgtcgcaaaaaattcgtacaatgttgcttgatcatgcaccctaatggctgtcttgatgcgcaacagttggtcaatataatcctgcaattgattggttattagttcagcattagtcatcaggatggccgcccacatcgtggggtccgaactggcaatccgagtaatacttttaaacccaccagccgctaatcgcaacccgagtgccgaatctgccaaagccacctgagtctgatcaactaaagccgcagcgacaatatgtggcaaatgacttaactgtcctacaatccggtcatgctgtattgcagtgaccgtcaaccatttgacgtgagtcgcttgtaacaatgcttgcagccgttgaacggctgcttgattagtccggcccggcaccaacaagtaaaaggcgttctcgaataagttggcgcggccagccgtcacacccgatttatgtgaacccgccattggatgaccgccgatgaaagtcacaccgtgctgttgtatggcaagcgcggcatgcatcaccacttgtttagtactcccgacatccgtcacaagcacccctgccttgagtggcatcatagccagtcggtgcaagtcagcaacgatcacatcaactggccccgctaaaataatcacatcagcgtcgctcgcgaccgcggccaaatcagtgccactagcatcgatcataccctgttgacgcgcataactcaggctgacatcgtcacaatcaatcccaataatgtgcaccgtgggatgggcctgcttaatgcttagtgccaacgaactgccaattagccccaaacctttgatcaatacagttgtcatcttcacaccccctggcttaaacgtgctaaatcttcaaagaacgtcgggtatgaaatgttcacagcttcggcggactctagttcggcgggagcggctaatcgcaacgctgcaatcgccatcatcataccgattcggtgatcgccatggctggctaatggctcggtcggctgccgccaagacttgcgaccatcaatcacgaagccatccggttgcgaagtgatctgcacaccaagttttcgaagctcggtcacaatcgttgcaatgcgatcggtttccttgactcgtaattcagcagccccattgattgtgctaataccattcgcagtcgcagccaacaatgcaactagtggcagttcatcgattacggcaggaatttcagtagcagtgacttggaccgggtgcagttgtgcaaaccgcacgtcaagcgtgccaactggttcgcccattcggtgtccatgatcgaccgtcacttgaccacccatccggcgcaaaatgtttaagaaacccgttcgtgtcggattcagtcccacgttcgttaaccggacatgtgaatttggaataatcgtcgcggctgtcacgaaaaaagcagccgaggaaaaatcgccaggaatcgttagtgaccgaccaaccaaggctggctgcggttggaccgtgattgttcgctgatcaggcgccgtttcaatttgaccaccaaattgttgcaacaaccgttcagtgtggtcacgagtcggtaatttttcaataattgtacttgcttgatcggcctgcaaggctgctaaaatcaaggcgctcttaacttgtgcactagcgacctgcatctcggtacaactaccatgtaaagtccgaccagtgatcgtcatcggtaagtgcccggctgttaattgtacctgcgcccccatggcttgtaatggttgacgcactcgctccatcggccgttgactaagagacgtatcaccgaccaaggtcgtctcaaacggttgaccggctaacaacccagttaataagcgagtggccgtccccgcattccccatgtctaatggttgttgtggttgggtcaacccatgtaagccgcggccactgattgtaacggtcgtatcgacacgcttgattggcacccctaacttttgcagcgccgttaaagtcgataggcaatcggcggctggcaaaaagtgatgcaagatcgtcgtcccttgactaattgcccctaaaatcaagcctcgatgtgagacacttttatcgcctggtacacttaagtcaccttgtaacccactagctggttgaatacttagtttttttatcattaatcatcatcacctaatttatttgatagacgcaccacaccatcgaaggtgtcaaacgtgcaagttcacgttcatgagtcgtcagtgtcacgtttttctcattagttagcacgtaggccgcctgattacgttgataagcctgatacgctaaatatttactggcgactgtttgcaccacgacctgatgcacgaccctcgtcaacaattgggcggtcgctgcatgcgtgtaaccaatttgattatcggcatttactcgttggagcacgacaagtggatcgagctgggtcataaaacaactgctcaacgttaattgggacaataatgcgtaatgtatatccccccagctggcattcagtgtgtctgatttgaaagcagctggtatcaccagttggtcaccagaataggccgttaaatcagttaaaatggtttcaaagctcgggtgttcgacaatcaccgcttggtcctgccagttgcgatgattataaacttgcgcggccgcgtaactatccgtggcggtcgggcctaaagtatgaatctgcataagccctcctaatattgtcggagttcttcgcggtatgccgtcactgtttgctggaagcgagctaagttactcccgtcaaacgttgccgtcaatgctcgcgttaattcaatcgctaccacactttcaaccacaatcgaggcggggacgatggccgtcgtgtctgaacgctctacgctcgccttttggctgactttggtcgcgatatccacactttgtaatggtttgtaaagtgttggaatcggcttcatggcggccttaacaacaatcggcattccattagtcatgccaccttcaaagccgcccaaatgattggtcaaccgtgaccagccggcgtgttcatcccaactaatctcatccatcacttggctaccataatggctggcagccgcaaatccatcaccaatttcaacacctttcatggcgttgactcccatcactgctgcagctaactgtccatctaatttggtatcccagttcgtgtaactgcccaaaccagccggcacattttcggcaacgacccggataacaccacccaaggtatccccggccttcttcgttgctgtgatcagctcatggatttcgggaaccaaggccgcatctggtaatcgcaaatcattttgcgcgatttgggcttgtaattgatcaacggatagtgttaaatcggccgtcacttgcttagggccaatttgttgaacgtagccaactaggtgaatatctagctgcgccaataattgcttacaaatctgaccgatagccactcgcatggctgtctcacgagctgaggaacgttctagcacgtttcgtagatcgcgatgaccatacttcattccgcctactaagtcagcatgccccggacgtggacgagtgacttgccgcaacgtattggttgccgtagctggacttaccggatccatgattgctgcccagtgcgcgtgatcgcgattcataatcgttaatgcaatcggggaacctagcgtaacaccgtgccgcacgccaccagtgatttggacggtgtcatgttcgatctgctggcgattgccgcggccaaacccaccttgccgggctgcgaggcctgtattaatggcatcaatgtctagctgtaagccagccggaataccggtcagcacccctgtcaattgaggcccgtgcgattcgcctgccgtaacgtaattaatcatgatcaatatcctccttgtgtaaattcgtgtgtaaatccgtctgatatgcgcgtgagttatgcataattgcttgataaatagcttgtaaataaggggtatgcgcggtctgggtactcttcaccgcaacttgttgtaacacccgttgttcacgttgctggtctaataccggaagttgctgttgttgcttcaactccccgatggctgtaaccgtctcaaaacgttgattgagtaatcggacgatttgctggtcaatatgattgatacgttggcgttcttgactaagtgtggttgggacatgtagcgcccatacagctaggccgacaaaggcgagaccactgacagcaataactaaatcaaagcgcatcgcggtcgcaatattttgctttgacagccacccagtcacgagcggaatcgtgaaggaagcaatactgccaaacgtgaaataaattcctgtgattcggcccttgatgtggggatagcctttgataaataaattgaggccgacctgcatcacgccacccgcagcagtaaacccaaacccgaaagccgccagcatggacagcccagccgctggactataacagataaccgctaacgccagcagcgagccgccattcattgccaacaacaatttggtttctgccaccccacgacgtaacaaccagaaaatcacaataacgccggtgattgacccaatgctgtaaagtgaaagcaaccagtgcgctaacactgacgaaaaatgcaacgtcgtagtggcaaacaagctgacccactgcgtgtagaggatcataagtgccatcgaagtatacccataaccagctaaaccaactgtcgccaaccagcgccggttcttaagtggttgctgggatacgcccgttccggcttgagcaacttgattttttagtggaaactgctgccggttcaacaggatactgttgaccactaggattgccgcggccaggataaatgaccagccataccagattcgttgtgcttcaaagttggcaacgagcagtggtaataagaattcaccggcagacatgaaggcctttaacaagacattggctgagccttgccgcccacccatttcaataaacgtcgtgtaggttcccgcatccaacgcggagttcgcaataccggccaaaatcgccaaaccgtatgccagctgaatattagtgaccaatgccatccccacaaagaacgtgaagtagcaagccatgccaagattgacgaagactttacggccaaaacgatctgataaatttcccagaataaagtaggccagtaagcgcccaatgccaatcccagaaatgacataggaaaccgtcgctaacggggtctgccagtgttgacttaacgcttgcatgttttgcgttaaaataattaagccaataccatgaataaagtagtttaagtaaagactgattgataattggtgctgacgcatgaataacaactccttcgtggaaataaaaaaagccggctagattgtgaaaatctagccggctcatcaaaatttaatcctaattgatgatattattccagctagactcacggtgtctagctggccaagatgaattgacttcgcttagacacgaacgtaggtgccgtccgtatctaaggttccaacacgggcgctacctaaaataagcaaagccataataataagttgcgttgaatgctaacgtcgtcataatcatctatcctttccgtttcattgattgcttatattaaaacattctcattttgattcgtcaaccctaatttcattttaattttgcaattaagaaatcattttcgcttgtaaaagcgccacgatgcgtaattcgcctcatcctactactatttacaaaaatcgtcttcagtacgactactcattaaaccaattgtttgcgacggtcgcgagcaggctaccttgattagtcagtctaccgacaacgttcaagcagtgtgtgaatgactagtgtgaccctacaatcagcaccatctaaaccgcttaacctcagtgattgacagcgaacggctccattcaatttgaacacaaaaatagtcgctgtcaatccatctggattcacaacgactatttttccagcgcctaatcttgacgctttaagttattaattaattcatcaatccggctaccgtattgaaccgagttgtcgcgttcaaaagttaattccggggttttatagatgctaagtcgtgagcctaattcactacgaattaatcccgtcgccttagtcaatccagccgccgtcttttcaccatcggatgccttatctgacaaaatactgtagtagatggtcgcttgttgaaggtcgccagttaccgttacaccggtaatggttacacccgcaacccgtggatcacgaacccgttttaacaaaatatcattaacttcgcgttcgatttcctgttccaaacgaccaactcgataatgttgtgccatctgctaatcccccttttaaaggttattcaactggaacttccttcatcacgtaagcttcaatgacatcgttgactttaatatcgttgtaatcttcgattcgaagcccaagttcaaagccttgtttaacttccttaacgtcgtccttgaaacgccgtaagctagctaacttgccatcataaataacgacaccatcacgaatgacccgcacaccagaatcccggtggatgacaccatcagtgaccatcccaccaccaatcgtaccgatcttagaaaccttatagatttcacggatttcggcttgaccagtgatttcttctttataagttggttcgagcattcccttcatcgcgctctcgatttcatcgatcgcgttgtagataacttgatgcaagcgaatatcaacatcgtcagtatcggcttgggctttggcttgtggtgttggccgcacattgaacccgataataatcgcgttacttgcttccgccaaggccacgtcactttcgttgatcgccccaaccgctgtatggatgatattgacccgcacaccttcaacgtcgattttacgtaaactaccagctaaagcttcaacagaaccttgaacatcagccttaataatcacgtcaacttccttaagttcaccttgtttcattgaatcaaacaagttatccaaggtgacgtgagcagtttgcttccgttcttccatcaatgcctgcttagcacgttgttcaccagcatcacgggccgtcttttcatcatcaaagaccacgaagcgatcaccagcatccggcacatcattcaaaccagtgatttcaattggcgtcgatggcacggcttccttgatccgcttaccatggtcattggtcatcgtccggacttttccgtaagtattccccacaacaattggatcaccaacatgcatggtcccttgttgaacaagtaacgttgcggtagaaccttttccacggtcaagactagcttccaatacagatcccgcagcattttgcttagggttggccgttaattcgagcacttctgactgaagtaagatcatatccaacaattcatctaggttcttaccgaacttcgctgaaatctgaacaaagatcgtatcgccaccccaatcttcaggaatcagaccatattcagtcaattgttccatcacgtggttagggttggcacccggcttatcaatcttgttaacggcaacgatgattggtactttagcagccttagcatggttgatggcttcgattgtttgtggcatgaccccatcatcagcagcaacaactaacacggtgatgtcggtgatgtcagcaccacgcgcccgcatttcagtaaaggccgcatgtcctggcgtatccaggaatgtaataaccttaccatcatgcttaacttggtaagccccaatagcctgagtgatcccaccggcttcgccctctgtaacgtgagtatgccgcaattggtccaatagggtcgtcttcccatggtcaacgtgtcccatgaccgtaacaaccggtgcccgtggcgccaaattgtcggtattattaacttcatcatcaaagaacttgtccaaatcggtcacatcaacttggaccttttcttgcgcattgatcccgtaatcagtggctaagatttcaatcgtatctttatccaaggactgattttggttaactgcaacacctaacatgaataacttcttgataatttcagcaggctcacggtgcaataatttacccaaatcctgggcattcatgccgaccgtgtaaaccagtgtttctggcaacggcttgtccttacgaactggcgctggcttattattgacctggcggatccgttgattcttattgttccggctcttattgttccggttgttacgccgacggttattgttgttaccgccacgataacgaccaccaccgttattgttgctattcaaactaccaccaaagcgaccgctgccattacgcgaactattattcgacccattgctccggttactgttgttattattgttgttcgtcgtagtccggttgttgttccggttctgaccaccattattggtgcgattaccggtactgttggtacggttgttactcgtatttgagcgattgttattattagaccggttattattattattgttgttagaccggttcgtattgctcccaccgttattacgagcactgttgctccgtgaagcattggccgaacgattgccgttattactgttagtacggttaccgccattattgcttcgattaccgttactattacgactttgactattattttggttattattacgattattattcaaagaatcaccactctgttgatgacgcgagttggattgctgctgattagcagttcgtgtcacattttttgctacggcttgcgtagcccgactcgttttagctggagccggttgagatttaggatgggtaactgtggtcgtgccttgtaactggcgcgcctcactgtcaccgagtgtcgacatatgatttttgacggagaatcccaactgctgtgcttgcgcaatcagctgtttacttgggacgttgagctccttcgctaactcataaattcgctttttccccatatcttcaccctcctttactgtgtcatgatcgccaccattttcttggcaaatccggcatcggtaattgcataaacagtgcgcttattaccagtagccgtatttaattctgctttagtaaaggtatcgatcactggaacatcataagattgggccttatcatgaaactttttggcagtcgtgggaccggtatcgctggcaataaagaccagtttagccgtctgattacgaattgcagccagggctagcccttcgcctgcaatttgcttgctggcacgccgtgaaaggcccagtaggtttaaacaagcttgcttaggcgtcatttccgaagagttcctttcgggcttgttgatgatcaacataagccactaactcatcgtaaaagtctgcacccactttgataccaaacgccttatcaaaagtcttttcttgcttggcacgttgtgcaacttgtacgtctaaggcaatgtaggcgccgcgtcccggctttttaccagtcggatcaacggacacttcatcctgcttattcttaacgacccggactaagtcttttttgggatgcatttcacccgtcacaatgtcctttcgtaacggcacttttctttttttcataatcccagacctcctttagttacttcactcacttagtgacgaacttattcagcgtcacttgctgattcatccacagcagtttctgaggcaggcgtcgccacggctgcgtcggacgttgctggttcctcatcttcgccggtatcggactgcactgccgcgtctgatgctgcttcagtcgtttccgtttcggcaactgcaacatcatcagggtttgcatccattatatcagaagcttcggtttccgatttaatatcgatcttgaacccggtcaatttagcagctaaacgagcattttgaccacgcttaccgattgccaatgataattgataatctggaacgaccacggtacaaccccgctcattttcaggatcaaaaataacatccaaaacttccgctgggttcaatgcattcgcgataaatacggcttgatcatccgtccattccacgatgtccatattttcgccgtgtaattcattgacaatcgtttgaacccgttgtcccttgggaccgacgcaggtaccgactggatcaacgttaggattgtttgaacgaacagcaactttcgcccgatcaccggcttcacgtgcaatcgaaacgatttcaacgatgccatcgaaaatttcaggaacttcttgttcaaacaaacgtttcaacaaatctggtgcagtccgcgaaacgaatacttgggggcccttcgttgcgttttcaactttcgagacgtaaaccttaattttgtcatgaatccgataaacttcaccaggtaactgatcagaacgacccatgaccgcttctactttgcccaaactaacgtagacaaatcggttatcttggcgctcaacttcaccagtgacgatttcattttcatactggctgtattcgtcataaataatgccacgttctgcttcacgaactcgttgcatgatgacctgcttagccgtctgcgctgcaattcggccgaagttcttcggtgttacttcaaatcgaatatcatcaccgatttcgtaggctcggttgatagccaatgcatcttgcaaactaacttctaaacgtgaatcaaagacgtcttcaaccacttctttaacggcataaacgtgaatattacccttaatttggtcaaagtcaacttcaacgttttgagcctggccataattacgcttataggctgaaacgagtgccgcttctaaggcttcgatgacaacttcttttttaatgcccttttctgattcgagggtgtctaaggcccctaataattccttgctcatgtgtagactcctttacttatttagaactttaccgctaagcgggcttgtgagatttgttctcggttgatcgtcaccgtcttgtgacgtgtcttatccaagtaatcgatggtcaaagtggtcggcgtcaccgccgtcaaatcaccttcaaaaattttcttgccatccaacttctggtataagccaacgtgcacgtacttaccaatagcattttgaaaatctgcttccttcttcaatgggcgttccgcaccaggagaagaaacttccaaaaagtaagcttggggaatgggatcaggctccatcgcatctagcttttcactaagttcatcactaaccattgcacattcttcaatattaatgccgcccggtttgtcaatgtataatcgcaaataccagctttgaccctcgcgaacaaattcaagatccacgagttcaaactggtgagcactgacaatggctgcggccactggctgaatggtttcaacaacattactactcaaggctgcgcctcctattcagattagtccaataaaaagagtgagcatcgctgctcactcgttaacgagttttaaattacaacccatatattagcacaattatgttgaaaccgcaagtttacgccatttatagcatttagccgttagctttcaagtcacggtaaacttccgcttcaacagcctgacaattgccggtgtatcaacattacaggccctaaatcagataaatctgtctgagtgctgttaaatgcatcaaccaccgcaaaaattcatcaaactttaacaattgtcgtgttttctagaacaacgagagttggttttcatctggcaaatcacttaacacaccattttcagtcataaagtcgatcaaactcttcgacacttttccacgcttagacaggtcttccttcgacaggaacggcttgtccgctcgggcagcaacgatttgcttggcaacgttcaaccctaaccccggaactgctcggaacggcgcaatcaacgtatcaccatcgatcagccaatccgaagcatcagatttgtcaaggtcgaccatggagaatttaaagccccgctccaacatttcgttggctaactctaaaacggtcagtaagtttttctccttggcgctagcatccatccctttgtcagtgatcgccttcattgacgctttgacagcatctttaccatgggccatcgcaaccaggtcaaaatcgtcagcacggactgaaaaataagccgtgtaataaatcaacgggaagtacactttaaagtaagccacccgcaacgccattaagatataggctgccgcatgggcccgcgggaacatatacttgatctttagacaagattcaatgtaccagtcgggaacgttggcatccttcattgcttgttgccattcatccgggatcccccgacccttccgcacgtgttccataatttggaaagacatatcagattccatgccgtagtgaatcaagtcggtcatgatgttatcacgacaaccaataacttcggccagcgtaaccgtgccatccttgatcaattcttcagcatttcctaaccacacgtcagtcccgtgtgaaagtcctgaaatctgaagtaattcgttaaacgtggatgggtgagtctcttcgagcatcccacggacaaaccgcgtcccaaattctggaattcccagcgtccccgttttcgagaaaatctggtcttctgtgactcctaaaacttcaggactggagaaaatcttcatgacgtgcggatcaactggtggaatactctcaggttggacacccgacaaatcttgtaacatccgaatcatcgtcggatcatcatgtcccagaatatcaattttcaaaatattatcatgaatcgaatggaaatcaaagtgggtcgtttgccaggccgcactctgatcatcagccggatactggacgggcgtgaaatcataaatatccatgtaatccggcacaacaataataccggccggatgttgcccagtcgtccgtttaacgccagtcgttccctttgctaatcggtcaacttccgccgaacgaagtgtttgattcgtatcccgttcatacgccttgacataaccataaccagtcttatcagcgaccgttccaattgtcccggctcggtacacatttttctcaccgaacaagactttggtgtaattatgggcaataggttggtagtccccagagaagttcagatcaatatctggcaccttgttcccataaaatcctaagaacgtttcgaagggaatgttttgcccatcacgcaccatgtcagtcccacattcagggcaatccttaggtggtaaatcatagcccgatccatactcgttattcgtataaaagtgcgagtactgacaatttggacaccgataatgcggtggcatcgggttcacttcagtaatcccagacagcgtcgctacgatactcgaaccgactgacccccgagacccaaccaagtaaccatctttattactcttaaacactaggcgttgggcaattaagtaaatgaccgagaacccgttaccgatgatactcttcagctctttatccacccgtttttggacgatttctggcaacggattaccgtaccacgcatgggcacggtccatcgtcagtttttcgatttccgcttcggcacccttcatccgcggagtatacaacttatccttgaccggtcgcacgatttcaaattggtcagcaagcgcgcggggcgtgtcaaccacgacctcatgtgccgtctccgtacctaagaaatcgaaatctttaagcatctcatccgttgagcgaaaatgcacgtctggccgttcagtccgatttaacgggttaccgggctgtgaatgaatcaaaatcttacgataaatcttatcctcaggattcagataatgcacatcccccgtagcagcgaccgggatattcatctcatggcctagttccaccatgttgctgataatttcttccaaatgatccgtatcagcaatcaaaccactctcgatcagcgccgaatatgccggtttcggttgtacttccaggaagtcatagtagccggccttttgtcgggcctcttccttccccttttgcatcattgcagtaaagacttcaccactagaacaagccgaaccgaccaggatgccatcccgatacttgtttaaaacactgcggggtacacggggcacgcggtaatagtactcaacattcgacaaggaaataattcggaagagatttttcaaccccgcttgggtttgcgcatacaatgtcgcatgaaatggccgggcatggcggtaagccgcattttcattcatatgatcattcagctgatcgtggaattgaacctgataacggtcctccgcatctttcaaaaacaggtggttcaaatgaccagtcgtctcagcatcatagatggcgcggtgatggtgctccaaattaacgttgaattttttggctagggtgtttaagcggtacccgcgtaaattcggatacagccaccgcgccagcgtcaacgtatcaataattggatttgtaatcggccccatgtgatgccgggcatagcccgtattcataaagccaatatcaaaggtgacgttatgaccgaccacgattgcatcaccataaaattcgcggaaaagtttaaacacttcttcttccgatttagagccccgcaccatatcatcggtgatactcgtcaaattagtggttgtttccgacaagtgaaaaccagggtcaataaattcctcaaactgatcaacgacgttccccttgaccatcttaaccgctgacaattcgatgacccggtcataaatggcggacaaccccgttgtttcagtatcaaaaataacgtaggtggactctttcaaatcaacgtgggcgtcattataagcaatcggcaccccgtcatcaaccatgttagcttcgacaccgtataaaattttgatattatttttttcaccagccgcaaacgcttctgggaacgcctgcgcccccgaatgatccgtaatcgcaatcgccggatggccccatttagcggcttgtttgacataatcactgacactgttggttgcatccatctgactcatattagaatgcaagtgcaattcaacccgcttctcatctgccggcgccgtgtcttgccgactggcatgcgacgtttcgttaatatcatacgcattgatcgttaaatcgcgcataaaactatcttcctgcacagaaccacgtacacgtacccacattccaggcttcagtgccgcgaattgtgcctcgtcatcagcattccgtgagaacttcttgacgaccattgacgaactatagtcggtcacctttagaatcaataactgccgctgggaacgtaacgtccgcacttccatatcgaagacatagccttccacgacgaccgaccgttcttcttcagtaatttggaccatctgtttagccggctcttgcgggttgatctgcttgcctaattggacaggaccatcaattggtgctggtgcatccgcctgcttttgccgtttctcattggcctttttgatagccgcttccgctttttgagccaacgcttgatcagacttcgctttttgttcatgaaattccttgatcttcgcctgtgaagcactctcatcaatcatcgtgtggacggagaacttcgggaagcccaagcgatgataggtactctcaatcggccctaatgcttggttagttagaaaattttgaataacttcattttcagccaacaaaatgacccgaccatcttcataagtcggcacgttgctgttacacaatgattggaccaggggcgacttgatcccactgtgctgaacgatccattcccagtattcagctagttcacgaccattgacctcggtatcatcagtcacgatcgtaaaggtcacgcgtgcaatttctttaaaggcgatttggagtttgttttgaaaagtcataaattgtgtataaggtaaaacatgttggaaatgcaaatgaaattcccaaaccttggaagcttgatgaacggtcaatttatcgatcgctgcttctgtaaattcaggacccgttggcatttcaatttgttcgagtaacttctcgaacatttcttgttggtttaaactcaccagtggtcctccttttgttgattacaatcagttagtaagacacgcaccgtacttgttaatttgcgcttgcatatatattaaagcaaatccaatcttaaaatcaaaagccgctaaccgtgacccgctagaaatagaatctcgtttcaacaatgacttagtcgctaacaactaacccaatgccaagcaagacttttaatattaactagaaccccaattaagtgctcaaggccgcggtccacagttggcactactttgtcagtttgcttaaccgacagcgtgatgcctcggtgattaacggcatctgaaataatcttcagcgaacgcacaaatcgttcacttgaaacgttactattttatcacagtctgaccgttgagccacgtgattaatcggcaaacaaaaatcacccagtcaacagaatccaaccaggtgattgttgttggcgactatcaacgggtagttgccatatttttattaacttagttttgcagcattttaatcgatattcttgagcagaacggccaagttgttggcgatttcttcctgtttaacttccaaagtctcaccagtctggcgaagcttaatctcgacgattccttcgctggcctttttcccaatggtaatccgagcaggaatgcccattaagtcggaatcggcaaacttcacaccaggacgttccttccgatcatcatacaaaacgttgtacccagcggcttctaattgtgcttcaacttggtcggcaacctcaacctggtccgctttcttcgggttaaccggaatcacgtgcacatcaaatggtgcaattgcttttggccaaatcaacccattttcatcagcgcgttgttcagcgatggcagacaacaaccgtgagacaccaatcccatagcagcccataattaccggaatattacgtccattggcatccaagacttctgcgtgcaagtctttagaataacgggtgccaagtttgaaaatatgtccaatttcgatacccttggtgaacttcaagacgcccgcaccatctggtgataactcaccttcctgaacaaagcgaatgtcaacgtaagcttccgcgtggaaatcacgttcagggttgacgttcgtgaagtgatgaccgtcttcgttagccccgaccgtaatgttgaccatgtccttcacatactggtcagcgacaattttaacgtcatcatgaacgttaactgggccgagtgaaccaaagctagcgcccaaatattgttgggcttgttctggcgtagtcatttccaagaaatccgcaccaaggtaattcttcaacttaacatcgttgacttcatgatcgccacgaaccagtgccattactggctgatcgtctgcaataaacagaatactcttaaccagttggtcagcaccaacttttaagaactcagccagttcgtcgatcgtgcccactccgggagtatcgatcttttccatatcctttaacgaagcatgtgacttctttgggacgtataaactccgagccatttcaagattagccgcataatcactcgcatccgaataaacaattgtatcttcaccaaccggtgcgatggccgaatattcacgggaatcctttccacccatcgccccaccatcaccgatgattgaacgaaacttcaaaccgacccgctcaaaaatattctgataagcttgcgccatatcttggaacgtgtcatctaatgaggcctcatccgcgtgaaatgaataggcatccttcatgatgaactcacgcccacgaagtaatccataacgtggccgatcttcatcacgatacttagcctggatttgatacaaagtcaatggcaaccgtttatacgatttgatttcatcgcgaacaattgacgtaaatgtttcttcgtgcgtggggccaaggataaattctcggtcatggcggttcttcagcttgaatagttctggaccgtatgtctcataacgcccagttgctttccacaactcagctggaatgactgctggtaccagcatttccgctgcatcaattttttccatttcttgccgaatgattttttcaatattcgtcaatacgcggtaagccaatggcaaataagcgtacattccggctgaaatttgtcggatatagcccgcccgtaacatcatttgatgactcaaggcttcggcatcattaggcacttccttgagtgttgggattaacaatttcgactgtttcatctacaaatcttctccttattgttccaaattaaatatcacttagaagaaatatcgctgaatatcattccaagttactagaatcattaataacatcaggaggccaaaaccaatcaaggtaatgacactttccgtttccacccgtagtggtttaccccgaatgccttcaacaatgtttaataatagtttaccaccatcaagtgctggaatcggtaataaattaacaattccaaggttgatcgacagcacggcgagcaaatagatcaccgtgcgcaccccggacttagcggcttgcgaggtcgtggcaaagattgccaccggcccacctaaatcgttcaaactgaacccgtgagtgaccatccgaccaagcacttgaaaaatctgtttggtaattccccacgaaccagtaaagccgtatgctaacttggcccccagactcgtgtcggtcttagtcgcccattggaccccgatttgaccgattcgattaccagagaccgtcttggcagcaggggtaaccgcaatttttttagtctgaccggcccggttgatggtcaaagtcaaccgttgcttcgggctgtcttgaatcaacagcgaaatcgattgggcactcgtcatttttttaccgttaaccgccacgatttgatcgcccttttgaataccggccgtacgggcaactgagtctgctgtcgtcgccgctacgtgggtcgttgtactcgtaacaccaccctgcataaaggcaagaattgcaaatgtaatgatggccaaaatgaagttattcatcggtccggcaaaattcgtcaacattcgttgccataacttggccgattgaaattggacgtcgaccggtgcaatttgaacttcggtaccatcgctttcaacgatcgtagcgtcatgatcgacggcgtagtgtttaacttcactttcgtccccgttctcataaccttcgatccagagttctttttcgagatcagtcgccgtcactgacagtggaattccattgaacaacgttgtcttcttactagcattgattgaatgaacaatcccatccggaccaatttgcaaactaactggcgttccgggcttgagttcttcatcttcatcatcggccacaccggccatccgtacgtaaccaccgattggcagaaaccgtaacgtataagttgttgcattacgacgaaacgcgaccgccttgggccccatcccgacagaaaattcacgcactagaatcccagcctttttggcaaagtaaaagtgcccaaattcatggacgatgaccaagattccgaaaacgataatgaacgtaataattgtaacgatcaattaagcgctcctttctcccgcgtttcgggtactcagcttaaaagaggccgaataaatgtgcaattggaaaaactaataacatactatcaaatcgatctaggataccgccatgtcccggcaagatcttaccagaatccttaacaccatagtaacgcttcaacgcggattctactaaatcgccaaactggccaactactgataagactaaagtaatcagtaccatactgatgacgctagcatagccgacgtgaaacccaattgcaaaggcactggcaacgatcacaccaatcacgctacccccaatacaaccttcccatgttttattggggctgatcggtgtgactttatgccgacccagtttgcgtccgaccatgtaagccccactatctgtcagccagacaatgaacatcaggaagagtaacatgtaaacactgacaccccgcgcagccgtgaagtagttgaagcccatcccgatgtacaggacgcctaacgtcaacattccggcatcatcaaatgaaaagcgattccgcgaccacacagtgtgtaacagtagcaagataactaagaagtaaaccacgtactccttgtttaattggtctggtaagccattgaaccagttattcggtgcaatttgaatcataactgcaagcatgcttacgattgcttcaaatgaaatcaataattttttacgcatcacgagtaactcgctcatcgcaacggcccctaacagcatggccacaatatctaaggttaccccgcccacaaaaatgactgggataaataaaattaacgcaacgacagccgtaatgactcgttgtctcataccaaaaactcccttttatttatgatccgacaacccaccaaagcgccgatcacggctctgaaaatccgcgatacaggcttgaagggtcgccgctgtgaaatccggccacttcacatcagtaaagaccagttcactgtaggcaatctgccacattaagaaatttgaaatgcgttcttcaccactcgtgcgaatcagcaaatctggatcattgtatggcgcaagtggtgccgtcatcagtgctgcgtcgatggttgcatcatcgatatcaccaaccgccaattgaccatcttgcacttgctgggcaattttttgcaccccggtcacgatttcggcccgtgaaccatagttgagagcaaagttcagcaccatcccatcacaatctttggtatctgcaatcgcattttggactgctttttgcgttgcttctggcaagtgatcaacgtagcccatgacttgcacccgcacattattttttatcaagtccggtacgaaagtatcaaagaaactcactggcagttgcatgaggtaattaacctcatcagttggccgcttccaattttcagttgaaaacgcgtaaagcgtcaggactttaacgcccaaatcacttgcggcaatcgtaatctttttgaccgtgttcataccttccttatggccagcaacccgtggtaaatgccgtgctttggcccaacgcccattgccatccataataatggcgacatgggctggaatacgttcaggatccaattgcacgtcggtgttatctgcaggatcattcttattaaaaaaagcgaacaaggcgcacctccataaaaatagcttaactatgcactattttaccaaaaaaagcactaattaactattcgtcaacaaaaaaaggcttgaatttctccaagccttaataaattggtcggtcattaaccttccaaaatttctttttctttgtccgcaacgatcgcgtcgacgtccttacccgcttgatccgttaacttttgggcttggtcttctaactgatgtaactggtcgtcagtgaattgaccatctttatggcccttcttcaaggcttccattgcatcacgacgcacgtttcgaacggcgaccttggcacgttcaccttccgccttaacgtccttggcaagttctttacgccgttcttccgttaattgcggaataactaaccgaatcgcagaaccgtcgttagctgggctaataccgaggtctgacgctaaaatagccttttcgatttctttaagggcactcttatcaaatggggtcaccattaagacccgtggttcgggtactgtaattgccgccatctgattaagtggtgtttgcgcaccgtaataatctgcagaaatccgattcaataatgatgcgttagcccggccagcccgaatattaccgagctcgcgttgtaaagcggcttccgccttcttcatccgttcctgtgcttcttttaaaattggttctgtaattgccatattatttccccctgactgttgtcccgatgtgttcaccggcgacgactttccgaatgtttccaggttcattcaagttaaagaccacgacaggaatgtcattatccatcgataaggaacttgccgtagtgtccatcacttgtaaccctttgttgataatgtcgagatgggtaagcgtatcaaatttaactgcactagcatccttgttaggatcagccgagtaaacaccatcgacgccatttttggccatcaaaatcgcatccgcgttaatttcagcggcccgtaatgcggcggtcgtatccgttgagaaatatggactcccggtaccaccggcaaaaataacgatccggcgtttttctagatggcgcattgccttccgccgaatgtatggttccgcgatttgtcgcatttcaatggatgtttgaacccgggtcggcacaccaattgattcgagattatcttggagtgccaaggcattcataatcgtagctaacatgccaatataatcagcttgggcccgttccatacccatctgggcaccagcttcgccacgccacatattgccaccgccaacgacgattgcaatttgtacgcccatgtcatagacgtccttaagttcctctgccaccgttttaatgacggggggattgattccaaagcccttctcaccagctaaggcttccccactcagttttaggattacacgcttatatttaacttccgacatcgttttgtcctcctcgaaattatctgtctatcattttaccatatatttcaataagcgtttggtatcagccgtaatccggcgcaaaaattaaccgaattctctttttaaagcggcttcaacccgttactttacaaaaagggactacgccgaaaattgctttccgtcgtaatccccaattagctaatcccttagtcagtaattagtctttaatttggttcataacttcatcgatgaagttatcagccttcttttcgattccttcgccaacttcaaaacgaatgaatgagctaaccttgccaccctttgattcgacaaagtgcgcaacagtttgatcagaatccttaacgaattcttggtcatccaagctaatttctgaaagccacttgtttaaacggccttcaaccatcttttcaacaatcttttcaggtttaccttcattcaaggcttccttaacaagcacgtctttttcatgagctaaccggtcagcaggaacttgttcacggttaacatattcaggattgatagcagcgacgtgcatggcaacgtccttagcagtagcactgtcagcaccgtctaagacaactaaggctgcaatttggccaccgttgtggatgtatgaaccaaaactttggtcagcacccttttcaacaacttggaaacgacgaagactgatcttttcaccagttacttgagtcgtttcgatgacgtcatctttaaccgtcccgttagccgtcttcaaagctaaggcgtcgtcaacggaagctggttcttcttcagcgatcttgtcggcaacttcagttaccaagttcttgaacttgtcagttgaagcaactgaatcagtttcacagttgatttcaacaatggcagctttgttgtccttgattgcaacagcagcaatcccttcggcagcaacccggccactcttcttctcggccttagcaacccctttttcacgtaaaacgtcaacggctttttccatgtcgccttcagtttcaactaacgcctttttagcgtccatcataccaacaccggttttatcacgaagttctttaacttgtgctgcagaaatctttgccatagtttactctcctttgagtatcttgattttagataaaaagctgcccgcaaaatcaggccgtaatggtccgcgatttttaggcagcctaattatttcaattaattatttgtcagacttggcgtcgttgtcgccttcaacagcttcaacgatgtcttccaatgagtcaacggacttcttagcgtccttgttgtccttgaaagaatcttcagtaacatcttcgtcttcaccttgacgaccttcaatgacagcatcagccatcttagaagtgatcaaacgaacggcacgaattgcatcatcgtttgaaggaataataacgtcaatgtcatctggatcagtgttcgtatcaaccatcgcaacgatcggaatgttcaatttttgagcttccttaacggcgatttgttccttacgaggatcaacgatgaagattacatctggaatccgaggcatgtcttcgataccgcccaagaacttttcaagcttggcacgttgcttcattaataatgaaacttccttcttaggtaaccgttcgaaggtgccatcagcttccatcttcttcaagtctttaagacgcttgatccgtgtttggatggtgttccagttagtcaaagtcccacctaaccaacgatggttaacgtagtattgacctgcacgggttgcttcttcttcgattgaatcttgggcttgtttcttagtcccaacaaacaagataacaccatcatcagccgcagcgtccttaacgaagttgtaagctgagtcaatcatcttgaccgtcttttgtaagtcaatgatgtagatgccgttccgttccgtaaagatgtatggtttcatctttgggttccaacgacgagtttggtgaccgaaatggacaccggcttcaagcaattgtttcatagaaataacagccataataaatgtgcctccaaaaaatttgttttattcctccccaccgttcaactaatcatggcactctcccgagcaccgccatgattatcgcagtaggtgtgaattggttttaacgccgaaaattagtataccgaaaattactagtgcttgcaagcaatttcatcaagaatttgtgaattcctgaaagtgtgttaaaatacaatctcgcatagggggctcacttaataatgataaaagccatcatttttgaccttgacgatacgttgtatgatcaaaaatcaccgttcactgctgccttaactaaaacttttaaccaggctttgagcagcactgaattggcacaaatttttaaccggttccatgattttaatgaccgtacctttaaccaggtcactgatacaactatgacgctggaagcgtggcaaaccgcccgtattcgacacgcgttagcacccagcaaagtccacatcagcactgatcgggctatccaatttgaaatggcctatcagcaggaactaaatcagatttgccttttcgatgggctgagtgcgacgctgactaaactcagtcacgcttttaaaattggtatcattaccaatgggccagcgccgattcagcatcaaaagttacatcaattacaaattgaacatttcgtgcatccggataacatctttatctcagaagaattgggtattgctaaacccgacccatcgatcttcacgacgtgggcccatcaggttggcatcaaggccaacgaagccgtttacgttggtgacaatgcagcactcgacatgaccagtgccaaacacgctgggtggcaaactttttggtttaatcaccggcgcaatgaccaggtgacaccgagcgtaattcctgatcaaatcatccagagtccagcggaactaaatgaactattgctagcacttcttcaagccgccagcgcttcatagacgcatactggcgttaaagctacgagcaacttatgctggtaacaaccacggtaagtacgtgctagcaagacctttacctagcaacacttaattgtgttatcgctaacaaaatcgctcacttgtgaagcccacagtcgtgcaaccagctctattgtgggctttttgttatggataataacagcattgaaagtacgcttggggttaacgcttcgaaaaggccccatttaggtgaaagcataaaaaatggcgtcactcagatgagtgacgccattttcagtgataatcgagattaatcaaacttaacttgtgtgtcagctttaccagtttcgatgaattgtttgttactgttcattgaaacgtgcaccatgttgtgaacggcagtttcagtgtagaaagccgtatgtggtgtaatcaaaacattgtcgcggttgaacaagttcatgaagaccttgtcatcaatcgtttgaccttcaaggtctttgttgaagatcttagtttcgtattcatacgtatcaagagcggcaccggcaactttgccactgtctaaggctttgatcaagtcttctgaatcgatgagtgtcccacgagcaaagttcaagatgtaggcgccatctttcatcttgctgaaggcatccgcattcaacatgtggtagttatccttcaatgcaggaacgtgtaacgtgataacatcagcttgggcgtataattcgtccaaggtgtcaacgtacatgccttccttttcaagttcagcattccggtaaacatcgtaaccgataaccttagcgccgaagcctttgaaaatatcgatggcagcacggccaatccgaccagtaccgataacaccaacagtcatggtgtttaattccttggcaatatctggtgcccaacggaagtcttgcttagctaacttcttgttgaacaatggggtttgacgtaataattgcatcaattgcgttactgataattcagcaatcgcatttggtgagtatgcaggtacgttagaaatgtttaagccacgtgctttaacagtaggaacgtccaagttatcaacaccaacgttacgaagagagatgttcttaaccccttcgtcggctaacttgttcaatacttcagcagtatagtccttttgttggtatacatcggcaccgtcgaagcctttagctaagtcaacgttgtcttcagtaagtaattctggaactaatttaacttcaacatctgggttttctttcatccaagtatcgaagaatggacgttcgtcatcacgtacagcatatgcaataattttcattacaaaaattcctcctatatattgatacagtaaatattataacagtaaatgcgagaaatagaatcataaattgtgaaaacttcgctaaatttttacatcgtgagctgacaagtattttagcttggcagctcgcgattggtgtttgaaggcatattcagcctttaacgcacttgatttgtcactgaaagtttcatggtaaattaattgcaaaggccgccgtgagctgacccgcgtatatttagcccctttgcccgcattgtgcgttgctaatcgtcgctgcaagttatccgtaaaaccaccatacaacgtttgatcagcacataataggacataaaaataatattttttggttgccgtcgtggacgcagccggcttacttgtgcttgccatagagtaatgtgtgcacctcttccctgtattcaccatcatcacgataaacgacaagcggtggcatgattcgaacaccgttgcgtttcccatccttgatcatttcgatcagaaccatgttcgcttcccgttgtgctttgggatggacgaaccgaatccgtttgggtgccaaccgattggtcgccatggtactgaacaagtcatctagtcgttcaggacgatgaacaaaatatgctttaccattcatttttaacaaatcactagttaccgctaggatctgatctaaattagcggacagttcatgccgtgcaatcgccaaatgaggatttggatttttaacgctctgcggtcgatctttaaaatacggtgggttacataagactgtatccaccgaatctttcggtagttggcgcgtaatttccagtaagtcttcgttcaggactgtcatttgttgggttaaatcgttcaaaacaacactgcgttgagccatatcggccaaccggggctgaatctcgaccgccgtaatatggccttgagttttagcactggcgaatagacctactgcgccattgccagcacagagatccacgatctggctcttaacgcccttcgcaacctgggcaaagtcacccaacagaacagcatccagtgagaacgcaaagacttgagaactttgaatgatttgaatatcttgactatataattgatcaatacgctcatcggcgtgtaacgtgacatctgccatattcggccacctctccattcaattcgtcgcacagctatcatacaattaacttgcagaatttgccaaatttcgtcatactgtgagcagttattaaacgaaaggaagatcgtgatgttttattcatttatgcgcggactagtccggctaatcatcaccattattaacggtcggccccgctatcaaggacgggaaaacctaccagagggggcctatatcttagttgggccacaccgcacgtggtttgacccgttgtactatgcactggctggcagcccaatgaaatttagctttatggctaaggaagaactatttaagaatcccgttctgcggttcattctcgttcatgcgaacgcctttcctgtcaatcggcaacatccaggaccttcagcaatcaagacccccgtcaaatttttgcgcagcggtaagctttcactaatcatgtttccatcaggaacgcgccactcacaagaacttaagggcggtgcaaccgtcatcgctaagatggccggtgttccactagtcccaaccgtttaccaaggcccattgaccttcaaacaactctttagccgtcagcgggttaccgtccgtttcggtcaaccgattgatattgatcgtaaactgaaattggatgaagctggtcaaaaacaaattgagactaaaatgttgcacgcttttgacgacttggatcgtcaaatcgacccaacgttcaaatacgttgatcctgctacaacccgtcagaaacattaagttcgataataaaaaagtgtcggtgatcgcaatttaaagcgagccgacactttttactacttgttatcgtttttagatgcagctttcatcgaattcaacatctgatgtaacttcttttcggatgggcgttgacccatttgcatcatcatactacgaagcatctcttcactaattggtggattttgcttcaagtaattttgcatatagtgccgggcaccgaagaaaccaccagttaacccaaccaatacgccgataacgacgattaaaatccaaattcctgtagacacagtcattcccctcccttattacagtcttcattaaactagtctacacaaattaataataaaagaaaaggaaaatttgtcagttgacaaattttcctgaaatcggttaatcatctcgaagaccgcgatcgcgttgcacttgacggaccttttctggcgtaacctctttaccatctttatcataaacctgaagcatttcaacttgttgccgaaaaccggcgcgaaattccttcaagtatttttgccgcaactcttgacgttcggcttcttctagctcggtgagcccctcggctttcgccttatgagctaactcattgatccgagcaagcaattcttttgaaatcaaatcagcagcccctttcactcttgaaatatacacgaaaatagaccctaaatcaattaatagtgtttgtcaaccgaacatttgtttgaaagctatgaaacgctatgctacaattggtttaaccaataatgaaaataaaaaatgaggtgccaagatgagtaaaacatcggaaagcaaacaaatggccgttcttcgctttatttatgaacgtgtcaatgaaaaaggatacccgccaaccgttcgtgagattggtgaagccgttgacttatcttcgacttcgaccgttcacggccacatttcacggctagaaaaaaaaggttacatccaaaaagacccaactaagccacgtgccattgaggtaacgccagccggtttcgaagcactgggcgtcgaaactacgccacatcaaattccggtacttggaacggtaaccgccggccaaccaattcttgccgtacaggaagcgacggattattttccaattcctaaggaacttgaatcattcggtggcgaccttttcatgctcaccatccgtggcgaaagtatgatcaatatcggtatcatgaatggtgatcaagtcattgttcggcgtcaaagttccgctgacaatggtgatatcatcattgccatgaccgatgaaaatgaagcgacttgcaagcgattcttcaaagaggccgatcactaccgactacaacctgagaacgacacgatggccccaattatcttgaacaacgtctctgtattaggcaaagttgtcggtttatatcgcgacatgctgtttcagtaaactatcacccacaagatgacaattcaatttgtcatcttttttgttcgccagtttttagagcaggttgatggcatgcctacagattccactcacaaatatttacacccttcccgccgtgccagggacgagagcacgttatttgcgacaaaagcacgcccccattccgaattcaccttgccataatcccgcaatgcccaaccgattgccttctgaataaaaaagtcatcatcaccccgattcgttagtatcgccgtttgtaaattggcaatccgtcctctttcaagcctaatcgaagcgcgatacctactcgtcgcacctatttatcggtagctcgtaaatataccacccacttgttgtaaacaaccgtgcgctgagagatacgctgcaggcaccttgcgccaggcatcaacactatcccactgtggcgttactgtgatttggtggtagcaccattgctattgaatcagcggcgcctgattctcccgatgtatcgacagaaaaagtgctggcgtcaaattggttattagtcggatctcttttcaaaatatttcaaatctgtgacgaacagccaatagttcaatggtataatgattatactattttaaacattgggagttggttacatgttgttcctagccattatgggcttgattgtttttctattagcattattttccgtgatttacgcacgtcaaaccggtggtggttggaaatttctaacactaattacggtcctcagcgccctggtcaccatctacgcggtcgttaaattgccttactggccatacaaccagtcacagcaatcggcgcgcaaagcatcatctagcacgagtactagcgctagtaccagcaagtccaaatcaacgagcttgagttcctcacaagtcgtttttaacgaagccagcaccaaacgcgcggccgcaacgactaagttgaatgaagaaaatatccttaaacaattacaatctaactatcaatcgattggtaccgttgcattcaccaagtcaacgaaaacatatacgattacgccaaccaataaaaagtacgttaaatctttgaagacgattaaatcatatccatctcaaaaccaaaaagcaatcaccacgattacttcgaattttaaatcgttgtcaaaatcgctccaaaagaatcttgccgctggttacacgattcagttgctacaaccagataccactgacaagacgctgttgagtgtccaagatggtcaaattatgaccaataacttcaaataggaaaagtcacttgtctagcaaatttgctagtaacaagtgacttttttgtttaaacttgttgatccaaatattgacgttgttcgttcttttgaccggtcaatacgaatcgatggggatcatcagcatagctgaccgactgatcatcggcccgccattgcaattgatgactgaataaggcttcatactccgccacactaactcggcgacgacgagccaaccgttgtggtaggccatgatctaaaccggtctgataatccggctgaataaccccggtataaaattcaccctcggcacccgagccataactgaataatccgagtcgattccctggttgtaactgaggatcagtcagtaactgcgataacaagctcaaatagagtgaaccagtatacaagttaccaacttgtcgatttagctgacgcgcatgttcgaagtgcgccaaccactgggcttgtttctcggcatcaactaatggtaacacgcttcgaagcgctttaagtcccatctttgtatatggcaaatgaaaaaccaaggccgtcagtgtgtctggactagtttgagtcgtttgcaggtaattcttaaacacatcttgaaaataatcaatatagatattagacgagtatttgccgtcaactagggcttctgtatgatacaacggtcgccaaaagtccatcacatcttcgctcagtagacttgactcagtacccagtactaatactttaggatccgcactaattaacatagcaaccgccccaccaccttgagttggctcgcccggtgtgttcaatccgtagcgtgccacgtcactaccaatgaccagcgcctttttatctggatgaacacgcacgtgatcttgggccagttggacaccagccgtcgccgcatagcaggcttctttcatttcaattgttcgaacccgctgactcaaaccgagcaacttagcgacgtaaatcgcactcgctttggaattgtcgatccccgactcggtaccgacgactaataaatcaatagccgcaatgtcagtcgctgtcagcatcggtgcggcagcattagcagctaacgtcactacatcctgactcggcggaatcaccgccattttagactgaccaataccaatcaaatacttatcaggttctgcctggcgagctgttgccagttccgccatgtctacgtataaatgtgaagttgcaaaatgcaacttgtcgattccaattttcacgtcttttcctccaatttgttaatgacaataagggattaatatgcacgtccgcgtggccctaagtaatgaaaatcagggtcagttccgacccgatagcagccgaaagcccgactaatttcattatgaaaagtcacaacaattgccggtgtcgcccaagtagacgccgcccaaaaaacggtgtcatcaaacgcccggttgtcattcgggtagcggtgatagccttgtacattgtcccaaatggtgccgtgcgtattcaaccaatcttcagcaagtccggcgtccacctgcatcatcacgtcttgattatcagcaatcaaactacttagtttttgccaatcgagttgccaatcatgaatatggggattcagtccgcgtgtgccaagtggtgtatgccccaatgcgatcggtgtcaattctacaaagtccatcttgaccaccccgttcattaaccatcctaagatttcttaactattatagcatttcacgacaaaaatactgcccgcaattgcttgacctgggacgggttccataatttatgctgttattaaataaggcgatcaagacaagcaccaagtaaggagcgcggtaaacatgtggttctcacgtcatcaaaaacgaaatagtcttcaggcacctgtcgctggtacttatacggcgattcccactgccacatcaccccaacaaatcgggctattagccatacaaccgaccagtccggtgattaatgccccgattgatggtgatatcattagcctgtcaccctcgcgtctcgttatcaattcgctgagcaatcaacatattgaactgcgtatcgaccggacgaacttccacaacaactgtacctggcaagtacgcgtgggcgattccgtttcaccattaacaattgtagggacactttatggatccttaaaagacgtcaccatcgctgtctatcgaattgataccattcaggccactaattgggtttcactcgcaaataattagctgtttacggctatagattcatatccgctaattgggcatttcggttgtcaaaatataaatttgacggttgtgaatatttctaagtccaccttgacacccatcgcccaatctcaaaaagataaatcacaataatcacttttccaacagcttcaacgggccatgctactgtgcccagttggagttgtttttttgcaaactactcaacactgccaggtgtgaaatttgaaataacatgacgcatcgctgtcgacgtacttgattggtggtgtaattgacaagctatcgtgacatcattacaatttttgtggtttgatatttgattgctttataccttaattcaagctatgatattcatactggtttaaaatttctttctttattaatcagtaggagccctgattaatagatcaatctaaaaattataaaaaggtcggatacaattatcatgaaaaccatgagtcttgttgttccatgctataacgaggaaccaacgattgaaatcttttataacaccgttgaaaaagtcctggcagataatccagagtcgttcaaggatatcactactgaatatgttttcgttaatgatggctcatctgacgacactttgaacgtactacgaactttaaacgccgcccatcctgacactgttcactatgtctccttttcgcgaaatttcggtaaggaagctggtttattagccggcttagaacacactatcggcgattacgtcgccgtcatggacgttgatctacaagatccaccaactttattgcctaaaatgctggcgatgcttcaaaccggtgactatgactgtatcggaacaatgcgggaaaatcgtgtcggtgaaccaatgattcggtcattcttatcacgctcgttttactcagttgtcaacaaaatttcaaaagtacaaattattccaaacgcccgtgattaccggttaatgacacgtcagatggttgatgccatcttggaattgcccgaatataaccgattttcaaaaggcatcttcaactgggtcggtttccgaacgacttatttgaagtttgagaatcagccccgctccgctggcgaaacacactggtcaatttggcagctgttcaattattcaatggacgctatcgtcgacttttcagatgtacccctgaagattgcgaccttcaccggtggcttgctctcactaatctcaattatcagtatatttgtcgttattattcgtaaaatattatttgataacagcgtcagtggttgggcttcaaccgtcacaattttgctcttaatcggcggcatccagctgttctgtctggggattatcggtaattatattggtaaaatttatatcgaatcaaaacaccggccccactacattgtgcaggaaaagaagtaaacttttcaacctaaactgagacgcatacgaccatatcgggaaaatggtatggtcgtgtgcgtttcggcatctggatgaagttaaaggttatgaatgaaattattatttaaaagctcttttgggggcatcagtccttgtcaagttgatgaatgaaataatatgatttttaattacttttcaaacggcttcatcgcggtattcaaatgcggtagagccgtttctttgtactattcgtatgatttcattaaagtattaaaagcctggttaaaggtatcaaccaccgcctcgctggttggctgacttaactaaagatgttttagagcgccgtaaatcgggctttgtgcttgttattagcccataaacgacttcggtggaatcggataatcctacttggttagactgagttacttgatttaatttcttacttagtttgtttgatgcgttgaggccgcttaatacaactttaacattttagatggagtacagatacagacatcaagtgtttaactgaaaacccaaaaccaatcgattcatgatgaagccacttattatagactgagcgcgacaaacctggcttgctaaacaaggtggcctgaacaccatgaatatccgagccgacggttttgattccttgataggctaatttatgttgtgcattcaatctttgtgctgtattttttggacttttttaaaaagaagtcaaacctcctgctccttgatttgaatcttaagttgacgtttcttgagccttagtcgttcaacctcagtcattttttcaattggtttcgtccatccaagccggtctttaagtgcgatgtaaccattggtggtggttttgagcatccagaaacggatttgctgataagatacattgtaatgtttcgctgctcgggaatatgcatgttcactcaccgtaatgtattcaacgattctaatgcgttcttcaaaagttatttttctactcataatgtggaccagcaattcactgatccggtcctccagccgtctagtacttctaaggccaaatctgatttgaatatcccacaaactactttcatcattcaagtacgctgatatggcctgccgcttaatctctgagatatatcgaatccaattgtgctgttcttttaatccttccagaccatcctgcatataaaaattttgacatctgatgaaagtacttcgagcgataccacacgctttaaaacacgttgatttagtcaggttagttttttcaagacccagaataatagctaatttttctgtgaccataaaattggttctagatataataaaatctccttaaaattgatagatgaagtatatcatttcatctatcaaccttaaggggactatagcacttaaaactgtctggctcgttttggttactgaatagtgtccacttgctaacgattatcggaatctaatgtaccgtgtacatcgtttcagtcctatctgaaactcggaaaccatttttcaacggcaccgctgctggtaatttaccaatagtagtattaccagcatgacctacgtacacatgcgattggccataatgcgtaccagccttagcttcatcagccttactttcaacgctttcatcgctggcataccgataatgtccattggttgtaaaggtctgcgaaggcaagtctggccgtagcccagcggcggcttgtagttgccgactcacctgtacgcgactgtccggataaacctctaccatactacggccagcaacatcaaacgttcgccactgaaatgtcaatcgttttactcgatatcgcttaaaagttttacgatttttaaacagtgttaacatatcgtgattcgtcaaattagtcctcatttgatctttcaaatcaccgacaactttggcccctttagacgaaagcccttcctgattcaagcgcttgaccattgcgtaaaagacggcttgctgccgaaaaccacggtgttgatcgttgtcaatatgtctttcgcgtgcataggctaatgcacgtgcaccagacatcgattgcaaacctgctttaaatttttctggttttccccagtaatcttgtccgataaaatcacgatcaacattaacttcaacgggaccaatatcatcgattgccctaataaaaccatcccaattaacagttagataataatcaattggtaaattcaaataatgttcaacggtcgctatcgccgctgcatcaccaccataggtatacgccgattcaatgcgctgataaccatgatattgctgcgaatggatcttaccaaaagtatcccgtaataaactacataaggtcattgttttagttttatggtttacaatgactaccatcattccatccgtgcgcgttgtcgataatttgcgcttgccactattatctaaccccatcaataaaaaagtactgaccggttgctgggtcaaattatgatgcgacttaataactcgtgactcatggaacgagtgcaacatgtcaaataaccgaataccttgaattgtgaaagctactaacataaaggttatacaactcgttactaatacaattagtcgttttctttgccatttaggtagttgccgccttctcataaactcagtccccccgcatttcattcatatcgcgcttaaattgatcagtaattgccattgtcttggcccaaatttgttgctcagtacgttgatttctaggcgtcttaatctgataagtgttcataatttgtgcaggtttccctcctagaacataaatgacatctgaaagacgaaccgcttcagaaatattatgcgttatcaaaacaatcgcttgcattttaaatttcctgcgttcccataatgtgatcaaatcttgccctaaccgctgccctgttaaaacatccagtgctgaaaacggttcatccaaaaggagcagttctggctcaacagcaagtgcacgcgcaaaaccaacgcgttgtttcatccctccagatagttcataggggtacgcatttttcaacccttttaaaccaatcaaattaattaaattgtcaatttgattgtcaacatattgacagtcagaattaagctgactttctaggccaaacatgatattttgacgtactgtcaaccatggaaatagcgcaaagttctgaaataccatactcatacggcgattaggagccgtgactaaattaccatcaaaagtaatggcgccatagctgggccgaataatccccgcaatcattcgtaatagtgttgattttccgacaccagacgaaccaataatactaataaactggtgggtttgaacctgcaaactaaccgcttccaaaatcagttcagactgccgttgttttgaaagtataaatgactttgaaacgtgatcaacatctaataaaactgcttttttcaacttaaactcctcctcgtattaataatgaaagcgacgttcagcaaatcgatataatggttgccaaatcaacacaacgcataacccaacaatgacacaaataatcagtactccagttgcttctgcaggcttattattgatattttgggcaatgtaagcaccaagtccagtaaccgcatactggtgggtaccccagctaatcaattcagccgcaatatcagcattccaggctgccccagcagcattaataattgcggtaatgaacgatggaaacagtgatggaattaaaaagtgtgtccaccaacgccaccctgacaggtgaaaaatattaacaacatctttgatatcactgggaattgccagataccccgcgataatttttaaaaaaaagtaccattgagttccagtcattatcaatggaatgacccaccaatgctgtgtcgtccctgtcaacgtaatcattaatgcaacaattggaatataaatatccgcgggaattgatcctaaaacttgtccaaccggttgaatcagttttaaccgccgcgcattactagcaacccatacggcaagtggaataaaaataagcgccgaaagtaaaacagctatcaacacacgactagggactgtctgaaaacnnnnnnnnnnagttttcagacggaccctagttgttaggaaggtccatttaaacaaaacactcaaattaatccaatcaagatattttattagtaatacacccaagcgatatagaccaacagctattactagccaccatgcaatacgccaatataccgtatatttttttaatatttgtataatccgtgaaaagcccagtttttgccattgctttggagcaccatataaccaccaataccggatatgacgatgtaatcgcttaactaacagcggcactttagccataaccaccaaatcatagacttgcgattgctgtggtagttggctatcggtactcgtaccgtatttataatgtgccgttcctttaatcagcggttgaaaaataaacacattgaccaataacacacagataactagcgcaatcactgcattaataacagcaccaaaattagctgtatcaagcgcaatctggatgtatgatccaattcctggtagcactaatgtttcatttttaggaaccacgatcgtcgcttgttcacaagcgactagggcaaaccaagcggccgattgagaaatgacaatattccatagaatgcttggcgtcgcataaagaaattctaagcgccagaatcgttgccagctattacagccaaattgcttagccactgtcatcaagtcttcgggcgtaacccgaagtgactgatagagagccaacataatattccaggcctgtgcagtgaaaacgccgaaaatagcaacggcctcaacacccagcacattattgggaaacaatcccatgaaccatgcagttgtaaacgttaaaaatcccaataacggcactgactccaataaattaacaatcggcaaaataacatagcgtgcacttcgatagcgcgctgctaatatgccaaaaatcaaagaaaacaatattgagtagcccattccaatgaatagtctcgttgttgttcgtaacgcagccgctactaaatgtgacattgttaagtagtctttacctcccgtagtatctaaataaccctgagtgggtaatcgactgagcggcaggttcatcttggcaatgcaccagccaatcataagcaatattccaatacttagtccaagccacatcatcgttcccaccacagaacgtactttaatccctctttttaaacttgtcatggtgactcctttccatgttcaagttgtttttaggcaaataaaaccccattagcaaattgcagctaatggggtaaaaaactaaaatggataacgatttttgcatcgacgcattcattgagttttagcactttaagacgtaagaactagtctagttatcttgaaagagccttaattcggcaaattctgctttactcattcctgtctctcgacatttctgggcgataacctatattcttaaagtaacctcacctaattgcaactgatttttattgctgatgtaatcaacaatgctatcatagtttcaagatctttaaccgtcaatagaaaccagctaatgataatcattaacaagtgattatttatactttttaggtttcctttataatcgtaactttttcttaactatttatctctaaacaaattactcgtactgtctagcttgaaatttggactttaattgccacaaaaatcctgttacttagtgaaaaattctcggtaccgaaaaaatggagcgcacgttaggatactgtgtcgcaagaaccaagccaacccccataaaatcgccaattatggccgaacctccctgactaacaaaaggtaacggaattcccgttaaaggtaacagcccaatcgtcatgccaatgttttcaaacatatggaaagctagcattacggctactccagtggaaacatagacataaaatcggcgtcgactagcgaatgctgagcgaaaaattagataaaacaagtacatgtaaacgataagtaagacactacagccaatgagcccagttgtctcaccaacaaccgaaaaaatcatatctgattccctaactggcacataaacagcgttatgagttacaccattcccagttaatccacccaccccaaccgctcgcatactttgccacaattgatagctttgatccgagacgccattgcttgggttaagccacgtattgatgcgatcaaactggtacaatttaaatccgatatgagataacagagattggcccgtgctcgatgtcgctaacaaaattaaaacaaccccaatggatccggccaccaataacacacgccacaaaaaactaaaccggcatggtgaaacaatgagcataccaataaaaattgtcagaaaaactaacgtcgttccaaaatcattgatgattttcaacgcaacaataattggaaaagtgtaaataactaagcgacgtgtcaaccgccaatccgcattaaaattattgtggggtccccactgttgatcttgaacgattaaccggcccatcattaaaatatagagcggtttcataacttcaactggttgaaaagtcagtgtaccaattgcaaaccaacttttagcccctgtttgaacataatattctcgactatagaagaccaataaaagtatcaataacagcatgccaattgaatagccaatcggggcccactgcatcaattgtttttcacttaggtgaagcatcgttgtcgctatcaatgcacccacaaggtaccagagacactgcatcattgtcgtccgaacaggatcaatcacttttaaatcatgcagacaagcatagtaaacagcccacataccaatacaacagagtatgatgacacataatataatcccccagccatagtcgccaatatgtttatgctcttgccaccgaccaagttctctattattcatttgttaccccccataaataaaatttataccgggcttagtatagcggtaaatccaagtattttatattttaagtggcttttttatgcttaattaatcgatttaaccggattctaaatattgcattaaaatcttaataatcgtggctaagcctcttgctagccacgataaattaattgatacaacatttgatcattattacggttaatattttgcacgttgttgactaatcgtcttaaaatcttagcgtcaatctaatatttgacgctacctttaaatcttttgaataaatatttattccagcagaaaattatgctatacttattaagtaccatatggagagttggcagagtggtaatgcaccggactcgaaatccggcgaaccggctaataccggcgcgcaggttcaaatcctgtactctccttattaaaatagtagagaccagccagtaaaaacaagaatcccaacaagcattgatttgtcgggattcttgttttttatataattcaaatcaaacaagtcaatatcaacatggtttgctacctactatactgtttggaaatggtatggatactactattacaaaataggttttagacttgagctactcttgcctgctccaaaattttggcactcaatatcaacgctttcttgaaccacctagaggttttctatactattggtttagtaacatgttctaaagctgcttctttaattgttgaatgccaattcaaattcattcacatcaatgccttattaaacatcggcacttgaaataatcataatgatcaacaacatcaatcaagtaataccattccccactaatccacaaaaaatatccgtcagcccttgccaacggatacccaattacttctgttcacgtgcggcttgaccaaaaacaaagaacgaaccaagaatacccacgcatgatagtaaaaataaaatgccatagcacagtacatcccccactgtcactaaagtcttcggaaaaccggcagttgagacccatagaaaaatcacgcttaaccaaaaccaaaatgaacgataaaaccgaaccggtcgacgtatccgcatgacgctcccccctaactcgtgattccaatgaaataaccgattggaataacgcctattataggcagtacgcaattaggtacaagctctgaatactcaaatccgacgtttaagttacaattcataaccgattacgtttgttaagtgccaatccgattaatatgccccctcgcaacctcaatcacgacgagccagtttacgagcgataatcataaatcggtcttcaaacgtcgtgacgcgaccattaatggccagtaaggattgtaactgatgtaatttgggaagcatccgtgccacgtcaaaattcggaaactcccatggaatcaccgtggcataatagacaattgcgccaatatccgtaaaactcagtgccgcgtaggcttgctcagcccgcagaatttcaaatcccgcagcctgcatttgagccattaccgtcaacaactgattgtcaggatacgccggttcgtaatgctcatcaaagaatcgtgacaacgcataattattggtcgcaccaacttgctgaatcacaagtcggccccccagctttaaaacttccgcaattcgcttcactggcatcgcaccatgactattcgttacaatatcaaatgtcgaatttggtacggccgtcaactgttcggcggcatctggatataatgttatcccctttttaaccaccgtttgcttcaacaactcaatatttggttgccacccctcagtcaccgcagtcagcgctggctgatggttaaaacgccccatcaattcaccaccgcccgtatcaatatccaaccaccgatcatcggcacttagatgctcacgaactagggcagcgtaatcccacggtaagtccgcagtctgccaccggccagccagatgactaaagtcccagccgtgcatggattgctgcgcttcttcaaaccaactgctttctaaagctgtcatattttgcctccttcgtttcctataaaccagaccactcatcaaagtctccgctggcctatttcaatacgaattatgctatgattacaatatctttaaaaggaggttcagtcaatgacacaattactggtcacaaccactgaaaatattccggggcacccctatgaagttatcggtgaagtctttgggctaaccactcaatctaagaatctggtccgtaacattggggcgggcttaaagggcctagttggcggcgaaatcaaggattacaccaagatgctcgaagaatcgcgcgatgtcgcggtcaatcggttgcgcgataatgcaagtgccatgggtgcggatgccgttgtgatgatgcggttcgacaccggctccattagtcaggatatgcaatcggttgccgcatatggtaccgcagttcgttttatcaccgaagacttgaccactgacaatgcttaactgattcgagactaacgaaaccgcctgccggtaatctgggcaagcggtttttagcatggtggcagctgtttgtataacacaattataattttcgtcaccggcgaatgaacagacaaccaccacaagctaacagtaatcccatggccgtcaaataagccgcttctgggctcacgatattatccaacaagaccaatccaacactgccgattggaatcgaaatcgtcgccaatgaatttatgatgccgcctaaactcccaacgatactttgatcggccactttcaataaactcgccatcaatttaggatttgcttgccccatacaaaatcccccaatcatcatgattgtaaccactatccaatagttttgccaaaacaacagattaataaataaaccctcaaacgccacgacggtagttaacatgacaccacgaaacgtccacctctgaaagtaacctgtatgtaacaaattccctgcaaccgatccaaatacgtcagcagtattcatcacaagaattgcgactccgaatgaaagtggtaactgcgtcgcccggtgaatcaggtataaattcaatagtgcatcgacgcttgcacctaccgcattcaagaacaagacgctccccaatagcgccaagacgttcatgtgcacccccgcttccattgcttgtcgcacttgtcgtagcagttgacgaaatgtcgacgtcacggtgacagttgcggaaggtaattttagcgtttcatacccggacagtagcaccagaccggcaatcaagaacgtgattgcattcaaatatcccgcgagacgataatcgcccgttgcggccaatagactgacacccaacgcttggcccatcgtctgcattaacactccgataccttggttgatccctaaggcctcttcttgtaactcagacgcgactttagcttgtaataatggcattcggaggctgccgctcaacatccccaacacgtctgaacacaaattgatgacaataataatcaacagcaacccgacctgtttttcagtaataagttgcgctaacacgagatataatgccgcttgaacaaatttcaaacctgctaaccacccccgcttattggtttgcgagtctgccaatcgaccagtaagcataccaaaaataccaggaagcacagtagccaccgaaactagcgaaaccatcaaatttgcttgtgcaaacgttcgcgcgtacgttaatagaataatgttaaataggctggtaccaattgtctcaaaaagatcagctactgttaacgtgacaaacgctcgattacggcctagatttttcataacgccacttccaatttaatattatttattgcttaaataaatttaaatgataaagcaactttaatcgtttgatttctatttgtcaaatggttaagctagtattgaggtgaaaaacatgtccaaaaacacactggctcagtttgcaaagttaatggccgatcccaaggtggccgctatcttaaaggccaccaaatctaaaactggtttaacaactaagcaaatttcggcccaaactaaaattcccaacaatcagttgtactacaccatcaacaaaatgcaggatgccgacttattaaccatcgttaatcaagttcaggttaaaaatctaactgaaaactactattccagtgcccacctctcccatgagacgccacaggatcttgatggtctcgatactgatctgactgacatctccggtacgtggactcaagcccatgtccaacaagttttacaatggatcatgctattgaaccacgactttaccgaagcctaccaggaagagatgacccgcaagcaacctgacaagtcagccatttttttcagtaacgcgatcctaaacctttcagcggtaggcgagcaccagttgcgcttagatttgatcaaattgcttggcgatgctgaaaagaatgatcctgatcctcagtcaacggacaagcgtcaggttaaactactcattgaaaagtggcaataattagaatatgcaattgttagtctttttggcttggctaccaaagaatcactgactatccaagctaactaacgaccaaaacaagggttagcaaaaaagctccgaatgactaataaatcgtcattcggagcttttaatattggctttaaaattgcatcaagctcaacatatcataatctttaatcttatcgcggccgtgcaactctttgagttcgaccaagaaagccgtcccaaccacgttaccgcctaattcttcaaccatttgaatcgttgctgagatggtcccaccagttgctaataaatcatcagtaactagcacattttgtcccggcttaattgcatctttatgcaaataaagtgcagactgcccgtattccaaatcataagtcgctttgaccgtttcgcgtggtaacttacccttcttacgagcaggtgcaaaaccaacgcctaattcataggccactggacaacccacgataaagccgcgcgcttcaggcccgacaatcatatcaacatgtttatcacgcgcaaattgcacaatctgatcagtcgcttcacggtaagcttccccgtcagccatcagtggtgaaatatcgcgaaaaatgattccaggttcgggatagtccggaatactagccacatacttttttaaatctaatgccatttgttcttaacagctccttcaattcttaaccgcagcctggttcttcacccatacttggagcgctgcagatttactatataaaagcgtttcttcagcaacgatttgttgttcgcgcagctgataactaggggcgtgatgtaaatccgcttttgccggattcgaaacgccattcatgacaccatcatttattttaacaaatccgacctcaaaaaacacctgaatcatgaaaataagcaaatttcgttcaatatgcagatgcttggccactaatgttaattgatgatgaatatcaacatcatggtgcgctgcggtaaactggaaaagtttcgcaaactgcgcgcgatttggcattcccgttaaataaaccgattcttgtcgatataagtagagcgtcagctgatcgagcgcaattgtgctgagtacctgggtcatatccgccagcgtgtcaggacaatcgacaatgaagaccgcttgattagccgtcacggcagtcagatccgttttcgtatcccccacccatacggcttgcgcttggtaacctaaatactgttcaacttttttcaacagacgctggtggaaaaagaggtaaacccccggtgcttgaaacaaatgggccgaaagatgttgcgtccgggcgtcgatcacctgggtccccgtcactgcaatatccttaaccatgatttggggcttcgtctgaccgttccaagtattttcactcaactcacccactaacgtcacatcggtgggactcgcctgaatagccggcaaggcagtacccatcgaaaaaccgatagcatcaatcgtattggtgccatcacccagttgtaatttcaagtgttgctgatcactaccgatcgcgcgtgcttgcggaacagtcgttggaactaattcaaacaacggtgccgggttatccgttccaaagggggccaacgcttgaatatctgccagagttgccaaggttgcctcagctaatggtaacgtgccgtcaattggtaaactgacttgcgcattatctgctaattgctgactaaccgccgccgcttccatcgcctctttaagcgttgctaactggtcggccatgacagttagtccaaccgccatatgatgaccgccaaaagccaccaatgactcccgaactgggtcgattgcggcaaataaattatacgcttcgacgctccgaccactacctttgagccggccatcatcatcctcatttaacactagggttggtttgccagtcgtttcgaccacgtggctcgcgacgattcccaaaacaccctcgtgccaaccatgcccggtaataactaaggtttggcgggcctcattttccggcgtctgtgcttgctcgattgcactggcactgattgtcttgaccaagccttggcgtttttcattcaattgattgacctgcttggccagcgcggtcgcccgctcatcgtccaaagttgtcaataattctacaccgctctgcgccgactgcagacggccaagtgcgtttagccgaggggcaataccaaacccgatattggtctcggtcaatttatcgggaatcagtccggcttcttgaatcagtgctgccaagcctgggcgggtcgtctgctgtaagaccttcaggccgagcgttaccaaagtccgattttcaccagttaagctgaccaaatcagcaaccgttccaatagcagccagatctaatagttcctcgggtacttcctcaagtagcgccgtcgctactttaaacgccacaccggcaccagaaagaccaccaaatggataactgccctctggatgtcgtggatggacaatggcgtaagcgtgcggcaattcagtcggtaactcatgatgatcggtcactacgacatcgatgccctgttcctgcacttgattgatgaccgcatttcccgcgacaccgttgtccaccgtcacaaacagcttcgttccagccgcaatcagccggtcaaaagcggcctgattaggaccataaccatccttgaaacgatctggaatatagtaattcacgttagcgccaatttggtccaacgtttcatacataattgacgtacttgttaaaccatctgcatcataatcaccgtaaatggtaatttgatccccggcaataatcgcctcttggatgcggtcaacggctttttccatatcgtgcatggtcgttgggtccaacaatggttgttgatccgcgtgcaggaatggggcggcttcttccgccgtattaatgccccgcattattaataaccgggcaactaagggggtcacgctggccgcctcagctaacttatcaacatcggcttcatcaacggccgttgttaaacgtggcacccactttttctttgccgctaacatggcatccttcctttcaacaacttacttatctgctggcgtggttggttgttctgccaccgctcgtttttgtttacctttattattcaaacgcaacgttaattgcttattttcggcagtcaacttgtcaatcttagcctgggccgctgctaaagcttcactatgggctgtccgttccttagattcattgaccgtcgccatcagtactgcggtaatgacacctaagatcaacgtcaccacaatgaccaaaatcagtggccaatgaactgctgtaattccaaaattgattcgaactggttctacgtttaaaattgcaaaaataatcactactagtgcaatgactagtgcactcactaaccgccattgattcttcattaaattcatcccctatttaaaattaaaaaccgtccccgtcagccaatccccgagcttgggtgccagctgataacctaaattagctgcagacatcacccaaggccgattcagttcgcgccgttgatgcccgagtttgcttacaatcaattcagcaaacttaacggggttcaatgccagctggtcgacccggtctaaatagtgccccgtgggatccgcaattttgaaaaagtccgttttaatgggacccggattgaccgtcaatacgttgacatgagcatccttgagttctaagcgcaacgcattatcataagcaataatggccgccttactagccgcataaacggctgatttaggtgttgcgattttgccagccatcgaggcgatgttgacaatttcacctgcatgttgcttgaccatccgttgcgcagccagttggctaacatacatggttcccaatgtattgacgcgcaacattttcgccatcaccggcgcatccatggtgatcaccgtggtcatatcgccaaaaccggcagcgttaatgaccacatccaattgaccaaatagctcatcgatggtcgtaaagacgtgatcaacgtccgccacgtgacccacgtcacaagtaatcgccacggcctgcccttttgataacagacgacattgatcagcaacctgtgttagccgttctcgccgccgggcggctaagacgacattggctccctgactcgccacagctagggctagttgctcgcctagtccactagacgcgccagtaaccaaaacagttttacccactaagttcgtcatttacttgacctaacctttctcaggtaatggaatatcaattacatcaaagtcacgaacgactttcgagtgactaaagactttctgtgcttgtttttgtagttccttactcaacttacccgtgtaccgagccgagatatgggtcaacaatagctgcttaacaccggcctgttgggccacctgggctgcttgggtactcgttgaatggtaatagttatgtgccaacttaccttcatcttttccgaacgtgctctcatgaactaaagcatccgcatcctgtgccaagctgaccgcgtgcggtgtccgccgagtatcaccgagaatcgtcaccgtccgccccttttgtggcgcagcgatgtaatcttgaccattaattgtccgaccatcaggcaacgtcaccgttttgccggcttttaattgaccatagacgggaccactcggaatgttcagggctttgagtcgatcggcttgtaattcacccgggtggtccgcttcttctacccggtaaccaaaacaagcgatccgatgatccagaggttcgcagcttactttgaacgtcgtatcttcaaaaactgtctcagctttcgtgatttcatgaaacttcaatggatatgacaaatgggtgccagagacccgcaacgccgtttgaacgaagtcgcggacaccgactggcccataaatggtgagtggttcgtccccgccttgaaaagaacgcgagctcaataaccccggcaagccaaagatatggtcgccatgcagatgggtaataaatatttttgcaattttgcgtggttttaacgtcgtgcgtaaaatctggtgttgcgtcccttcgccgacatcgaacaaccagacttcatttcgctcatctaatagtcgtaatgctgtgctagtgacattccgaaatttgcccggtgagccggcaccggtacctaaaaattctaattgcatatttttgttcgtcctatctatacagtctgctaactattttaccgaatctagcggcaatacacaattgttagcactgcaaagtcatggccggtcaacaccgtgcgctcaccgaccgcaattctaaaaagcaagcgacgttgggcgactcctcacaattaacaggaagaacacgaacaacgctgctcattttattttaacatgtcaggctaaaattatcgcacttggtttcaagattccacgtgccaagactgcctgccaccggtgttatctataatcaaaaaatgcacttttccgggcaaactgactatgacgggttgtgaccgttttcattcaacccgtcatcgccggcaaatgaatcctcagtccatcttgcttaacccaattgattatcgtatacttgcttacaaatcgtctgaacaagaggtaaccgttatgcgactcatcgactttaacttatcaaccgctgatctacagcaaactttaccactgtattgggaactaacgactaatcaaatctggccaatccaaagtgttacgctcgtcgatcaccagctggttttagtagcttcaaaaagcgcgctcccgctgacactcgaccagttcaatgcgcggacgcgccaaatcgatggtcaaacgcagctctgtattcaaaccccaccgcgcccgcgccgattatttggctatcgcttaagccagcagcgcttactgtttggctgagcatctaatcgcacgtcagctcaaaaacagcgtcgttagttaaaattctaacggcgctgtttttggattgttcattattttatcactagtctacctatcagactgtcgtaacgacaatcatcaactaattatgtcgtcacaaaagtttagtccataaactggaaggagtagtccaagatttgaatcgtatcatcattcttggcaccagctgcacgtaaggcatcatcaacacccatcccacgtaattgtcgagcaaagcgcattaaactttcttcatgatctaaattggtcatcttaaagagccgttctagcttatcaccagacaagacgaacaagcccggttctggattatcaatgctaaagtctgcatccgcttcagtcgtgtaatcacggtgcttcaagtcgtcaacacccttgattgggaattgtggcgtcgtatccaataaatcagccgtcttggctaacaaggcttttagtccctgttgtgtaatcgacgataccggatagacggctggcgtgtttggcaacgtatcatccgtcgctaacttcgccttaaagtcttccagattagcttcggcatccggcatatccatcttagtcgccaccacgatttggggccgcttcaagaggtcaggatcataactcgtcagctcgtgattaattttgtgataatcctcaaacggatcgttttcttctacaccactcatatcaatcagatgtaaaataacgcgcgtccgttcaatatgccgcaagaattgaatccctaagccgaccccgttagccgcaccttcaatcaaaccaggtaaatcagccatgacaaagtcacgaccgtcatccaaacgaaccatcccgagattaggcactaaagttgtgaagtgataggccgcaatcttgggcttagcactcgtgaccactgaaagcagtgtcgacttgccaactgaaggaaaaccaaccagaccaacatcggccaagactttcaattccattcgaatcgttaattcatcgccgggctcaccattttcagcaatttcaggagcagggttcttagcgctagcaaaatgaatatttccccgaccgccccggccacccttggcaaccactaaccgctgatctttattgacgatatcgccaattaactcaccagtttcagcatccgtcaccgttgtcccaagtggtactttgataattgtgtccttcgcggaacgacctgtcatctgcttaatcattccattgccaccagctgcggctttgaacttccgcgtataacgaaaatccatcagtgtccgtaatccttcgtcagcctgcaatacgacgcttccgccgcgaccaccatcaccgccagcgggaccaccattgggaacaaacttttcacggcggaaagcaaccatgccgttaccaccgttaccggcctttacatctacttttacttgatcaacaaacatgttcttttctcccgtttcttctatattattatctacgaaatccgatcgtgcgaaattagatacctgacctagtatacaaatcttcggccacttcgtcaaaagttccacgcctaattagacagatcatctttatttggatgctaatgacgatttgatgacaggttttggattattttgacggtttttgaaggtttttgttgcattttgacgtttaaacaggtatattattatgcggagggatttgaaagtgcttacagaagaacgtcaacagtacattttaaatacgatccgtttcaagggcattattaaaatcaaggacatctgttctgaaactcgttgttccgagtccacggcgcgccgtgacctccaacagctagaagaacagggcgagttactccgcgtgcacggtggtgcgaagtatatgaactcactccaagaggaacccgcgatgaatgataaggtttcccgtaacgttaacgccaaggaccatatcgcgcagcaagccgttgcgaacattcaagttgatgacgtcatttatttggatgctgggacttcaaccctagccatgattcaccatttaaatccgagctacaacttacgtgtcgtgactaatggtgttgtccatgcttccgctttggcagacatgggcatccaaacctacctgcttggtggcaatttgaaaggcaccaccaaagccgtgattggtcccgaagccgttaaatcgttagaggaataccgattcaacaaagtttttcttggtatcaacggtgtccacccaaaattcgggctcacaacgcccgaccccgatgaagcggtcgtcaaaaaaaccgcaattctacaaagtgaagaaagctttatcttagctgacaacactaagttcgaccacgtttcgtttgcgcgcgtcggtgatttatccagtgcaaccatcatcactgaccaactcacgccaagcgttgccgaacagtatcaaccattaactacgattcaggaggttcaatcatgatttataccattactgtcaatccatcaattgactacgtggtgcaactaccccaaatgaccctcggtagtgttaaccggttagcacacacggcgaaactccctggcggtaaaggcatcaatgtatcgcagattctgaacgacctagaccaacccaacaaggccctcggctttatcggtgggtttaccggcacgtttatcagtgatgctttaaaagccaagggcctagattgtcacttcacaccgattgccgatgacacccggatcaacgtgaagattcacgctgaagaagagaccgaattaaacggtgctggcccggacatcaccgccaaagaaacagaagccttctacaccgaattggccaatttaacgccgaatgacgtggtcgtcatgtctggtagtttagcgcctagtttaccagatagcttctactacgatattattcagaaggtcgaagctgctggtgctaactttgtcatcgacacgaccggtgaagctttgaagaaaactttacccagccaccccctcgttgtgaagcctaataaccacgaacttgctgattactaccacacgacgtttaatagccaggctgatatcattgcagcgggccaacggatgctagctgaaggtgcacaacacgtgctgatttcaatggccggcgatggtggcctcctaatcaccaaggatgcggtctactttagtcccgcaccaaagggccaggtaatcaactcagttggtgccggtgattcaatgattggtggctttgtcggcacgttcgccaaaacacacgatgctgttgaaagcttccgctacggcttagcttgtggctccgcaaccgccttctcagaagacattgcgacccgcgccaagatcgatgaaattttgccactcattaacattgaaaaactcgctcactaaagaaaggactgttaactaaacatggatatccgcgatttattactaaaagatgtcatgatcatggacatgcacgccacgaccaaggacgaagcgattgatgagttagttcataaatatgccgaacaaggtatcatcaatgatgaggccctctacaagcaagacatcatcaaacgggaagccgaatcaactaccgggattggcgacgggattgctatgccccatgccaaagataaggctgttaaccgggcaaccgtgatgtttgctaagagtaaggccggcgttgacttcaacgcgttagatggtcaacccgttcatcttttcttcatgattgctgctcctgaaggtgccaacaacacccatttagccgccctcgccgccctctcaagcttattgattgatcctgaattggtcgctaaacttaagaatgcacagtcacctgaagaagttcaacaactcttcggtgatgcccaggctgctaaggaagaaaaggaagccaaagatgcagctgccaaggccgaaaaagaagccgcagctgccagcaccaccactgacgaaaaacgtccctatttagttggggttaccgcctgtccaaacggaatcgcccatacttacatggccgaagcagccttgatcaaagccggtgaagcggccggtgttgacatcaaaatcgaaacgaatggttctgaaggtgttaagcacttattgactgccgatgaaatcgctcgtgccgacggtgttgtgatcgccgctgacaaaaaggtcaagatggcccgttttgatggtaagcacctggttaaccgtcccgttactgacgggatcaacaaggccgatcaattagttcaagaagccttgagcggtaaagctcctgtctatcacgatgctgatggtggtgctgcagatgacgatgaaggtggcagcgctaatggtagtgtttggggtgaagtttacaaagacctcatgaacggaatttcccacatgttgccattcgttgtcggtggtgggatcttaatggccctctccttcattattgagcaattcgttggtagtaagagcttagcctttaccttcttcaaccaagctggtaacatggctttcgccttcatggtacctgttttagccggttacatcgccgaatcaattggtgatcgtcctgctttgatgcccgggttcgttggtgggttcatggccacggtatacactggcgcttacggtggtgtttacacggcctccattaccgccaatgctaagagtcccgctggtttcttaggtggtttagccgctggtttcttagccggttatattactgtttggatgaagaagtggaccaagaacatgccacaatccttagacgggatgaagccaatgctgatcttcccaattctgggcttattgattattgctgcgctaatgttcttcgttgttaacccaatcttctcagttatcaacgcctggattacccacttcctaaactcaatgggtactggtaatgccgttctcctcgggcttgtcctcggtggtatgatgtcgatcgatatgggtggtcctttcaacaaggccgcttacgtcttcgcaactggtgcctttaccgcaactggacatgggaacttaatggccgctgttatggctggtgggatggttccaccattggcaactgcgattgccactgccttctggccaaagaaatttacggatgacgaacgtaaagctggtatctctaactggttacttggtatttccttcattactgaaggtgccattccattcgccacagctgaccccttgcacgttatcggttcaagtgtgattggtgctgccatcgccggtggcttaactcaactttggggcgttgccgtccctgctcctcatggtggcctctgggtctcattactcgccacgaatatctggggctacatcggtgccacaattatcggtgccgttatcgctggggttatccttggtctctggaaaccagctaaagcttctaaataatgtgatatctaaaaagacgatcaaattgatcgtctttttttgttttcaaaattaacgaatcagccgtctaaccccgcaataaaacgggtataatgaaagtaatatactgattatgttaacgagaatcgagacgagtttgatgaaactacgaaaatctatctttggcatcagctgtgtattattcggcatgatgctgctttccggttgccaaaaacaaactaaaatgaccctgccccctgtcagtcacaagaccttaacagcgatggtgatcagtgatgaccatgtcattgcgcccaggctgcatgataatggtaaggctttcacgcagtacgcggctaacgatgccggtgcggatttaaaatacagcgcgacgatttttcgcgcttttattgctaaggcgttaatcaccaagcctgacgttgtgctcatcagtggcgatattactaacaacggtgaaaaagccagtcacgagtacgttgccaagcagcttcgccgactgactgctaagcacatccgcgtctacgtcgtccccggtaatcacgacttgaacaaccccatcgcccgtcgcttcaaaggaaagcatcaatatagcaccgaggcgactagcccgacccagttcaagaagatctatcatcaggccggctacggccaagccagtgaaactgacccaagctcattgggatatttggtaaaacctagtaaacacacttggtttttaatgctaaactccgccatttataaaagtaattatcaacaaggtaattcaacggtcggtggtggcctgaccgatgggaccttacaatggcttactaaagtcggtaagcaagcaaaacaagcccatgcgactctcattcccgtcctacatcacaatacaatggaccacacggtgattcatcaggactatacaatcggttatgccgaagatgtccgtaaggcctttaccactgcgggtatcaagttatcgctcagcggccatattcatgctcaaaatatcaagtctaccaaagtcaagaaccagtcactgactgatattgccagtggcgccctgatactgggatctcactattacggtacgcttaagatcaaccagagtaacgggacggccacgtaccacgcgaccccgttaaacgtgagtgcttacatcaagcaccaccgtggtaataaagcgatgcgcgcctatcaaaagtacgatcatgacgtgttatatgcggctggctataacgcagcactgagtcagttatatgaggaccgtgacgaaacgcaactatcaagcgctaaagttaatcagctagcccgcggcatggcggccgccaatatcgcgctctttcggggcaccccagtcaaaaatagcgccgctattcaagcttggcaacaaatgccccacaatacaagtttgctcggcttcgtgttagccaccaagaaactacacggcaacgtgacgtggtctgggtccgtacaataaccactttataaactaaagacgacagcgaattttcaggctgtcgtctttttgattagtcactacttatagctggtcagtcacaccggcaccaccctacttcgattcggctagattggttttcgcacacgtagcatttggttaacaatggtcattaaataatcacgcttgctaaatccgacgacggccgttatcaaaatcaatagataacggagtataacactgtgatagcctcctaaaaatagaaagccaaccgccaaaaaagtgagcgtaatcagccccagtatcttgcgatcatatggaagcgtgccaagtttttcgcgacagattcgattcataaaccaataatgaacaaccgcatacatcacatagcaaattaatgttgtatatcccgccacctcgtatcctaaaattggaatcaaccaataatttagcgccacattcaatactgcgccaataacactggcaatcatgattaaagatgtccgttcataatagaactcaaactttgcaaataaatcaaaagcaaaaatgaaaaagacgctcattgcgattggtggaacgatccaggtcgccttagcatacgctcgtggtgcgaatatcgaaacgatttcgggcgcaaatgcaatcaatagcaggttgacaaccgcaattaaaactaaggcaccgtaagcgacacccgcaatatcggccacccgtcgatccttgattttttgatatatccacggactcagcgtttgcgacaatgcaacgttaaataaaatcatgatttgtgaaagtgagtacgccaaactataaatgcccgcacttttcgtatttaccatgttcgcaatcataatccggtcagcactactcagaacgatttgtgaaagataatgtggggccaacgggatgttgaacattaatgcgtgacgccaaaaatagcgcgagaaaaacgttttgccacgatacatttgcacaaaaaacaagcccgtatagcctaccagttccactaatgctagccctaaaaatcgagccgtcactttatcattcgcatacacaacgagcaatacgcctactaacggtttggcgattgcaaccagcaaggtcaccatcaccaatgatttgtattgcaaggcaactcggcgctcaccagcccaaaaattaaaaactgacgaggtccataccattagaagcatcgccaacatctgcgtcgtcgttaaagaaaagacactattccaaaaatcacgaaagccaagataaactagtgtccatgctaataccaacacaaccgttaatccttgtaattcagccgaatatcgacgtcgatcatggctgaatttgatgagaccttgagtataaacgccgtagcacagatttagtgagacgatgatcgtgacgatagtcagccaggagtacagcacattaaattgaccatactcggaagtagacattattctggtaaaaatgggcgttgcgattattgaaatgctcttttcaaaaaaagcacagattaagaaccaaagtgaggccttaacttgctttggcaaatgccgatatttatttctaatactgactaacataaattcctttctcatagatctgaactgagcatcacatcccgtgcttactaataacaaatctcataagcaccgcacacgttcaatcacttggttgttgtcgataccggcgcccatttaccgaccaaatcgttcttaaacgtaaatagttgatcacatagtaacaattatctggggatgtcaccattgcgcggactaacgcagccagggcctgaccaagttttcgtttgcgcatactggccatcgccatcgtaaaatatttttgcccacgattaaacgtactttgggcacggacgtcatttattttgtctgttaacgccgacatcccgcggccgaaactgtctgctcccgtccgtttacgttccgcatacaattgttgaatatagcgcgataccagatacgttttccacgcgtcgctggtcatactattaccgcgtaaccgatagttcaacactcggcggttaattgacccgattttgaatccattagcaagcagccgcagccagagatcatagtcctcagccgttggtaataaacggtaaccaccgacttgttggacggccgttttccgcattaaaacggtgggatgaataattgtcgaaccatagggcaggattttttgaattagtggttcagcctcgggaatggccgatttttcaccgacaacctcatcctgctcatcaagataagcaatatttccagaaattaaatccaaatcgcgcgtttttagcgcctctaattccacttcgagccgattagtgacagaaatatcatccgcatccatccgcgcaatcaactcattacttgctagctcaatcgccttattgagactagcggccaggccgaggttttctggattgcacactagtttgatcatttccacacggcaatcgtaatccattaacaagtcttttaaatcactccgttctggattatccagtacgatcacaaactccctcggcaaataggtttgcttcaaaatcgagtcaaccgcttgctggacttgctcaggtcgttcattatatacactcataattacgctgattgccattttttctcctcaatcttcaattcagttgaaagtaaataccccaagaatattattgccgtcagtaccatgccgctgcgcgcaaccttacctttataatttgcgattagtagaactacgccaaaggctagaaagattttactatcacgaacaacctttccagactttttgtggcaagccgtcaacgaggctataatcgtaccgtacagtagcgccatgtaaatgatgccccccataaataagtcattaataaagccaatgtcggacgttccgaaccaaatattgctggcattgccaccatatacgcgaacgccataaccaaacacccagtctaaaagctgactcggaaacatcaagaacgagcccgtcagttgttcgtaattgccctgcttactaccttcaaagacgagtgcaaacgtatcttcgaagccactgacgatccaggtatacgtatcaggttggatggattgcaaaaacgctaaacccaatatgataaaggtcacactcaatatgataatcaacacaacttgaaacagccctcgaacactggacagcattcgtttgaccagcatcaaggcaaaaccaaaagccagcgtgatcaagccagttcggccgtttaatacgataataaagacacaaaatggcaggaaccaataatactttttgccaaggttcattcccatatatatcgcaactagtcccatcagactatggtagattggtgtaaaaaatgtgtagtcactgctgattccatacaaacgttcaccataaataaactgattctgaataataccggtggctgtttttgctaaaatcgcagcgcgaatacccgaacttgccagcatgaccaaagcaaacaagcattgaacaaccaccatccatagcatccaggtcaagaccgtttcacttgtcacgttaaaatacttacgaagaacttctagccataacactaaggcaaggacattcaaaataatcacaacattttgaaacacccggggatcagttcctgccagtttcgctctgaacgcaaagtaaatcactgatagcatcacaccaatcacaaaaatgtgcagccgattaatagcaatcgataagtcctttggcgacaatagcaagacgcaaccaccagtaatccccagtgtaacaatcaggggcacataactactgctccaaaagttgggttggtaaatcaggtaaaatccggcaatcaatagtcctagtcttaagaatggcccaccaatctgacgatttactgcagtcatcgttccattactcctttataaacttgctggatccgctgaatgaattgcctttgttcatagtcactaaaatcgaccgctgctattttagccttggtttcctgataaaatttcccatccgaaaagagacgtgtcagtactgccaataattcagcatcactcgcataaaccaggccatttacccttgcggccgtttgagagatgcccccaatgcggggggcaaacggaatcgaacccaataaggctgcctcgaccatggtcaatccaaacgcgtctgatttggacgtcgacagcacaacttttgcatgccgcatgtatttgtaagggttacttttaaaccctaaccaccgtatttgcggggtggctgcaatctgtttagcgatgtgtgcgctcaagctaccatcgccgacaatcccaatctttagttcagggattgcgtctaataatttatgcgcaattctcacaaatcttgcgggatctttaacatcttccaaccgtcccacgaataacaggtcaaatgcagtggttgtactggcagtagccagttggcaaatccgtgaactgtcgattccattgggaataatcgccgtattggttaaatgtttgtggaagcgatacgattctttagcccaatctgaaacatataagactcgtgagctcttgttgccaatatattgaaacgccaaacttttccagttcacactagtctgccatatcggggcttgatggatatgggtgataattggcacatggtgaaaaagcaggttgaccaaaaaactcgctttgaaatcgtgtgcgtgaataatatctggctggagtgccagaatagctcgccgaaatttaagaagctgtttcggcgaaaaactttgatacgcgattccgacagcttgcaagctttcttgtatcgatcctgattgtgagcagtaggtgaaatcataggatccactcaaacccctactgatattaatgaccacctgctcagcaccacctaatttggcggaaaacaagacatgaacaatttttgtcatcgacaatcgtcccttctaggccaagcaacgcaaatagtacgcctgcgtttgttcgagcatctcatgctcagtatagtgacgttgatacatttgataggaattagtcttgacctcggcgatctttttcgattgatagagtgtcagaattttttcagcaatctggcgcgcgcatcattggtgaccaaaaagccattatgatcaatcaattcctgaatgcccccaacattcgacgcaataatcggcagaccttgggctaaggcttccactaaactgattgggagtgcttcataatcagaaatcagcaccccaacgtccgattgagaataatatttttgtacattatccaccaccccataaaagttcactttaccatccagattcaactggtgcgttagcgttttacaggcttcaatcgaagggccgtcacccagaaaatgacacacgattggtagattttccggcaagtatgtcaatgcttgaatcaggatatcctgccgttttggtgtatcaaagcgtgccgccattgatagtacaaagacctcggaactggtcgccttgtttgcgcccgttaatgctgtcacgccattatggataacacgagcaggatgagcactagtaatcacaccactttggacacccaaatcataatcaaactgcgagacacagatgtaagccgttgtcaggcgacttaatgctttttcaatagttttcatcaatagctgccgtttcttcccgacaccaggagtaaagccccagccatggaccgtaaaaatgactttcattggcaatctaatcgtggcgagcctcccaatcataccagccttcgaagaatgcaaatgaataatatctggctgccaattttttactaatttccttaacgtgtagattgctttcaaatcactcagcggtgcaatcggatgtaccaggctggcaactctgacaacttgcacgtcttgaaattctttcgcgacgcttgcactcaggcgtccttcaacgccgtatactaaggaaacggcattgccacgcatcacttgcgctttgatcaaactatatagatgcgcctgggccccaccccaagtcgcttgagtaatgatgtaaacaatcttcactaccgcgcaccatccccggaaataatcaccctaaccgttcccatcagcatcttgatatcaaaccaaatcgaaaagtactcaatgtaatagttatcgtactgacacttggcacccggtgtaatatcatagccaccattgatctgcgcatagccggtaatgccaggaatgattcgtagccgtttcggaaaatcaggatagcgttcactgaattgttcggttagttctggccgttccgggcgaggtccgaccaaactcatatcgcccttcaaaacattccaaaattgtggtaactcatcgatccgagttttgcgcatccagcgtccaaccggcgtcacccgaggatcatttttttgtgcccagatcgcacccgtctgcgcctcagcgtcctgatacattgatagcagcttaatcacgtcaaaggtcgtccccatccaaccgactcgcgcctgcttgtagaaaacgggaccgtcagaagtcaacttgataagtatggcaaacacaattacgatgggaacgctgagcagtgtgcccaataagccgactgctagatcgaaacaccgctttagatccatcttccagccggtgaccggaacaccaattttgctaataaattcacagtgttgttcgtcagccacgattgattcattaatctcaacttcgtgcatgctcacattccccttcccagtacttggttaatcctcttctcaacggccactctgattcataatttaagcgtgtcaacttgccaatacttgcaactgaatgatcaacttcaccaccccgctgctcggcccgtttgatttcaagttgttgaccagcaatctcttgatacatctgaataatgccatttaaactagtttctaagccattggcaatattgatcacttcatgttgcacttgatgttctgtaatcaaccataatgccttgataacatcacttacatatacaaaatcacgggtctgcgttccatcaccgaataatgtaaatggtcgctgtgttttcaaacaatccgtcaaaatcgacaaaacccccgaatacggtgagcttggattctgacgcggtccataaacgttgaagaaccgcacacaaacggtcggcaaatcgtacaactcaccgtatgccaatacaaaacgttcagtcgcatacttatcaatagcatacggtgacacgggtgcgacgcgcgaatcctcgcgttttggtaattcaggtagattgccataaaccgccgccgaagaagtgaatagaaattgcttaataggcaagcgaatttggcgaatatgttcgagcaagttaaataccgcggtatgattgacagcatgcgtttctgccggccgctcaatcgaatccgccacacttgcaatcgctgccagaaaataaatatagtctggccgttcgtctgctaacaattgttgcatgaatttatcgtcacagacatccgcgacgtatatcgtaatctgttcccaatgcttgatattgctgatggcccccattgacagatcgtctaccaccaccacctcaaagccagattcaactaaatgatcaaccaagtgcgagccaatgaaccccgcacctcccgttaccaatgccttcataactatttacccctctcaaaaaagccaaaattttcgtcgttgatttggtcgcaagacttcccctaacactactggatccccgttcagtagcagtcttgcattcactgcaaaagatgcaggattggtactatctaaccgtgctaatgcctgataacctgcccgcatcataaatcctcgtcgtgccatcaaatgcgcatctgaagcaatcacttggaccagcccgcattcaactaattccagcgctgtacttttaaccgctcgcccaaattgcccaacgagactccccgctgttagctgtgccaaacagccctgctgcactaaatcatagagccgctctggttgtgccataatctgagcatttcgctctggatgggcaatcaccggagtcgtcccttgctgtaagagctcaaagattacttgcgccacgtaattaggtacctgctcgtgtggcaactctagtaacaaatagcgccgaccaacatcaattcctagcaagtgcggcagagctgtcgccaaatcatctcgcaaatggacctcctgaccggcaaaaacggtcagtggaatttgttgccgcttaagttcggcctggagctcggcaacggcacgctcgactaccaggccggtattctgataacgccgatctagatgatgtggcgttgccaagacgtaatgaatgccatcagccaccgcttgtcgcgccatttcgactgcctgagcaagctgctgggggccgtcatccaatcccggtaataagtgacagtgcaggtcaatatactcagttggtctcagtcccataatagccgtacccataaccgtgagttttaatgtccacgtcatttaaaatagtcccgagtaattgtgcgcgagcattcttcaaggcactcactgcctggcgcaccgcaactttttcgacaaagttttggcgaacgactaggacagtgccatccacttgaccagctaaaatccgagcgtcggtcacgggcagtatcggcggcgcatcaacaatcactaaatctaacttacgtgttgcgaccgttaaaaacttggtcattctatcgctggctaataactcagctggattgggtggtttaggtccactcggcatgacaaacaaatgatcaagtacgggataaatggcttcgttcacgtccgtcagttgcccgcttaaccatgaactcactccccgttggttactgatcgcaaacgtctgatgaatcgtcggccgccgcaaatcagcatcgacaagtaagacttgcaggcctttcttggcgtattccacggctaagttgctgccgaccgttgattttccctcgccctgaatcgctgacgtgatcattagtgttttcaacggtttaccgaccatcgcatagttaagatttgttcggatcgttttgacttgctcagttacgactgacatcggtgccgtcaaagttgttaactgtatgccggtatgcatattcgctactcttcgcctcaatttcataaccgttcccccctatgttaaactcgtttgactgccgctttaacaactgacgtcaccggctgtggtttaatcgccggttggtcgtgagtcgctgtgaccggctgctgatgattaatgattcctagacttgtcagcattaattcatctgctaggtattcgagtgtctgcacccgccgattggacaagattcggacacttgcatacaccaatcccaaaatcagcccccccacgaaaccaattaggatattgatgatttttttaggcgctaccggctgatccggcgtctctgcgggtgcaacgatcgttacattattgaccctaataatatgctggacctgatctttaaacgttgcagcaatttggttcgcaatcattgcactagctttcgcatttttatcacgaacaacgattgaaaacacctgcgaattggccgtactggtcacgctgaccgtttgcttaagcgactcaagtgagcgtcgaatgtcagtttctgccattaaagtctgccgtgccggcttcaacacgactggttttgtaattaattccttataagtcgtaatcatctgcacatcggcttgctggcccgtcaaatccgcgcccgcactactgtgtttgcggttaactaatatttgaacattggcttgatattcgggctgaatgacccacaaagtcaccactgttgcaatcgtcccgcccaaaatcattaaactcaataataccttccaatactgacgaatgagtttaacaataaaatcaaaggttattacttgctccattccacacgctccaatatttcttgactgacttttattaaacgattgacattattgtagaaaaccagttgcaaacgacgcaatagttttcacgaattttcatgaaactcatataaatacaagcgaatattcgacaatctctaaatttaaattgacattatagacaataatgttatatttattgatagttactaatcaaaataatataaatcgtataattatttgactttattttagctcgtatttacccacaattatttcgattaaatcatcggttactccagcaaccaatgtgcttttcaactaatcacaaaatcgacatttttacaaatcaatgatgctttcaagcatcaaaaaagaccacctagttcgtgaaaactagatggtcttcttaacattaattacattagttagccagatgacaactatgtggcgcccttttgataatgcttcggtgttacaccaccaccggctaatgaaaatttgacagtttgtgcaacgtttttagcaattcccagggactgaatctcttccagtgaggcaccagcaattttactcatcgatccaaatttacgtaataatttattacgcgtcttcggcccaacaccaggaatctcatccaatcgcgaactcaatgaatgtttggtatgcacttgtcggtggaacgtaatcgcaaagcggtgcacttcatcttgaatccgttgtaacaaatagaatccttgactcttcggatctagatgtagatgctgatccccggccgaagcgagtaaatccgccgtcttatggtggtcatttttgaccatcgccgcgactggcgttgcaatccctaattcgttctctaagacgtccttagcagcttccagctggatctcgccaccatccatcaaaattaggtcaggcaatgctgcatgctccttcagtagccgtgtatagcgccgccgaatcacttcacgggtcgatgcagcttcatcagcatgatcgaccgtccgcaacttatatttccgatacaattttttattcggttgcccgtccgtgaagacgaccatggcagaaaccaagtcggccccttgaatatgagagtggtcaaaagcctcaattttatgaccagcgggaatacctaaagcatccgtgatttcttgcatcgcccccgtcgtcttgcgctcatccaattccaacaaccggaacttctcttctaagacgatccgagcatttttttgtgccatgtctagcaaatcctttttctggccgcgttgaggcgtccttaccggaattccgagaatgtcactcaggacctgcttatcaagaccgttggggactaaaacttcgcgtggtaaaacgttatttttacgattataaaattgcaagataaagctcgtcatttcttcaggtgcagttgacactactggaaacaagcgtttctcgcgcttcatcaaccgcgcttgccgaataaagaagacctgaatcgaaagccagcctttatcaagatagaaattaaacaggtcgcggggcgtattatcgtttgaaataattttctgcttttcaaccgtcatttcaatataattcagttgatcacgtaattcagcggctcgttcaaattctaggtcagcggccgcttgatccattcgtttagttaactgcttcttgaccgtttcaacgtgaccattcaaaaaggatttaatccgcttgatctgagcgtcatattctgccaccggcaccgttttaaagcaagctcccaagcattggcccatatgataatagaggcacggccgcttctggaaaccatggcaacgccgcaacggatagaccttctggataaaattgaccgtttcctgggccgcgtaaacgttgggatatggcccaaagtagtagccaccgtctttacgaacatcactgacgatcagaatctgggggtctcgttcattggtaatcttaatgtacggataaccggttcccttttttaatttaatattaaaatacggttgatgtttttgaattaacgtaatttctagcaggaaggcttccttatctgttgaggtcacaataaactcaaaatccgcaatttctgatactaaccgcgcggtcttaccagtatggctgcttttgaaatatgaacgcactcgatttttcaagttcttggccttacccacataaatgatctgactgtttaagttcttcatcagataacatcctggtaagtctggtaacaaggataacttatgttcaatatgcgcggatgccataacacaccttcccttcatttagattagcattattagtataccgcctgctagcatggggctcaaccaaacagcccggaaatatgatttttattatgaccgactattcatcactgtcgctactgatcacagtgtagcacatacccggtaatcagcaactgagctgattaccgggtatgtgttgtttacatcaaaattttagaaagaaaatcttgggcccgctctgtttgcgggttcgcaaagaattcctcaggcgtattattctcctgaatatagccatcagccatgaaccagattcgatccgctactgacttagcaaaacccatttcgtgagtgaccacaaccatggtcatcccatccttagcaagttcttgcatcacgtttaacacttccccaaccatttccgggtccaaggcagacgttggttcgtcaaacagcatcacttcagggttcatcgccaacgcacgagcaatcgccacccgttgagcctgaccacctgaaagactacttggaaaggcatccgcatgatcgtccaacccaacgcgttgcaataattcgtgcgcttgcttagtcgccgcggcatcatcgacatgcttgaccttcatcggcgccaatttaatgttttccaatacagtcatgttgggaaatagattaaacccttggaaaaccattcccattttttcacgtagcgcgttaacactcttcgtatccaaagttgtgagatcttgaccttcgaaagcgacttgaccacttgtgggcgtctcgagtaagtttaaacaacgtaagaaggtactcttcccaccaccagaaggaccaatcaccacgatcacctgaccgggttcaactttttctgtaatatcctttaaaacgtcattttcaccgaagctcttcgcaaggtctttaacttcaattactggtttagtcatgttgcattctcctttcgaagtagttcaagatccgtgaagcggtaaaggttaagatgaagtatagcaccataataacaacgatcggtgcaaccccccggtacgtatctgaacgaacaatgttactttgataaattaattcagtgaccccaataatcgaaacgatggaactatccttgatcagcgtaataaattcgttcccaagtgatggccaaatatttttcaatgcttgtggcaagaccacgtaacgcatcgtttcaccgttggacattcctaaactccgagcagcttccgtctgcccaacatcgacggaattaatcccgccacgaatatattcagcaacgtacgcaccagagtttaaggaaatcgcaataatcccagaagtcagtgctggtaaattgacgaataacccaagtccgaagtacacaaacatcacttggaccatcattggcgtcccacgaataaattcaacatacgcagttgctaaccaccgaatggcagtcttaagtggatttcctttagccatccgtgctaatgccaataaaataccgatgataaaaccgaagaaaacggagcaaaccgtaatgattaacgtatattcgatcccggttgcaaaagccttccagtaatgtcccattgacgtattaacggtattggtcttcaaatacttgccggctgccggtaagtattgctttttaacgaggttctgtttcttaatccgatcaacggtcttattgactttgttaacaagactagttgaacctttccgaaatgcgatcgccgaactcgttgcactagagctcatgttgaagtcactaggaatagcaaccaaactcttattgtttgcaacataggcttctgcagaaggcttttccatagcaaccccatcaactttgtgactctgaagtgccaaaatcagatcagattgtgaagtcatccctttagccttggcagtcgtttggtttttgacggcattatattgagtcgttccagtttgggcacccaacgtgccattcttgaatgaattcttattcttgtacttgcccttatcagtcttattgatgacaatatcgtagccaccttgataataaacgtgggtaaaatcaacatttttccgccgtgaaggggttgggttcatcccagagataatcatatcaaccttgccagtttggagtgccactagcaatgagtcaaatgacatggatttgatcttcagcttcacgcccagatccttagcaacttgtttcccaatctgaacatccatcccaacgatcttactcttaccgttgaccgttgcttgaaactcatacggtggataatcaggcgacgtccccattactaagacgccctttttctgaatttgttctaatgaattatcggccgcttgcgcatgttgcgtctgtccgagtgggacgacggtcatgatcagggccacaataatggctaaaaaccacccaaatctttttttcataggtattctcctcgttttgtaatttacaagaataaagtataaccgcatatgattatttatgcaagtatttttgaaaatttctttattttatgcataaataagtcgtttatacacgttttagcccattgattatgcataaacgacgaataactgacaaattgtcggaaatttgctatgataggcgttaatcgaaaggaatgattttatgagtttaaaagtacagcgtcaagataaccttgataagctattcgacaagtttgccattggtcctgacgataaggataaactcaccactaaagcggttcaggatactattgacgaacatgctaaacgcaaagaaaataaggcagctgataaaaaggacgcccataaatagcagtcaaaaaaaacgcgatggcagttagccatcgcgtttttatttgaataactatttagcaaattttagtcccgattgtttgcatcttttcgcgccgctctgcttccgtttctggtgaaacatcgcgccaatcaacaacagccaaagcaccgtcgagcatcccgctatcatccttgagcgctaaagcattatgccagcgagaaatgttgaggccgttccccaagtaggcttcatcagccggtgcaacgtgcatcacataaccagcattattttctaatggcgtggtatagtcgggatcagcggctttaagaataactaactgaaacttattaccaatggcacagctaccgcctaaactcgaatatttgttagaaccatcgtcagttgttaaaattacttgactccctgccggaatcttatctgcaaggtaggcttgagcatcgtctttgatattaatcttcatagttaagcatcctttccgtttcaaaaacatttaagttgtgcacaactcttttacagtctttaatttacgctatttcagctgcaaatgcaattaatttacctagaaaagtgaaaataaacagccgaactcaataatgacacaatttttgcaaatgatatgtggtcgttcgtcgcaataaaaaagagttgggctgccagccttacctgctgacagcccaactcttcaggttagaccactcttcaccgactatttaactggtttaccattcgggtacttatcgttgagtttaacaatattttgttgcgcaacttcttcgaacggaatatccgcccattcagcaacttgtgataagtaccataacacatcgcccatctgtttcgtcagctgatctttattcaaacgttcaccatgaaacgtatactttttgactaagtcaacgacttgaccagtctctgaagctaatcccagcgataagttcgtcagcacctgctcattaccatataatgtccgatttgctaacgactgatactcattaaattccaagttagttgcctcccacagtgtgcgcttcgatccattgccaaacagcatccttgccttctttggtcttagctgaaaaggcgataaaatcgtcttcagcttggaagttaagcgtctttttaattaaactttcctgtttgttccacttaccacgcggaattttatcacttttagttgccacgaccagtaatggcatctcatagtaacgcatccactcgtacattgcgacatcgtctttagttggcgcatgacgtgcatcgactagaataacgacacctcgcagtgtctctcggcttgttagatacgtctcaatcatttgtccccacttctcacgttccttcttagataccttagcataaccgtatcccggaacatcgacgaagtataattgatcttcaactttataaaagttcagtgtttgggtcttcccaggttgactagacgtccgcgcatagctattgcggttaatcaacacattaatcagggatgattttccgacgttagagcgccccgctaacccaatttctggaaacccagtagtcgggtactggctcggcgctaccgcgctcatgacaagttcaacgttatgcacttccatcgaattaactccttctgcaatcgtattgcattcattttaccataatttttgcagcgggttgtcatccgcgctcaaattcgctttaaacagcactcaggaccgcgaatgaaaactcatcgcggtcctgagtaatgtctattgatcttctgaacgaaacgttaggaagctttttgatcagctaaaaccagttctggttcagcgtgatcagcaaccgtctcgcgagtaataatcacctttttaacatcttcacgacttggaatatcatacataatgtcccgcatcgtgtcttcaataatcgagcgtagaccccgagcaccagtattacgtgctaaggcttcttgcgcgatggcacgtaaagcgtcatcgttaaagtctaattctgcaccgtctagagcaattaggcgttgatattgcttgacaagcgcattctttggttccgttaagatccggaccaaatcatcttccgttaaacgttctagcgcagtcaagattggaaggcgcccaataaattcaggaattaaaccgaattgtaagaggtcttctggcacaacttgttgcatgagactcttggaatcgtctagaacggcattcttaccatcggtgtccgtaccgaaaccaatcgttttatcgcctaggcgacgtttgacgatgtcttcgattccatcaaaggccccaccaacgatgaataaaatgttggtcgtgtcaatttgaataaactcttgttggggatgcttacgcccgccctgcggtggcacattggcaatcgtaccttccaaaatcttcaagagggcttgttgaaccccttcaccggaaacatcccgtgtaattgagacattttcactcttcttggcgatcttatcgatttcatcaatataaatgatccctttttcggcacgttcaacgtcgtaatccgcattttgcagtaatttcagcaaaatattttcaacgtcttcaccaacatagccggcttcggttaacgtcgtggcatccgcaatagcaaatggcacatccaaaattcgcgctaaactctgagctaagaaagtcttaccagaaccggttggtcccactaagctaatattactcttttgtaattcaggaccatcttcggtctcttcatcattatcagccatggccttaaccctcttgtagtggttataaaccgcaactgatagggtccgcttagcttcattttggccgatcacgtattggtctaactcgtctacaatttcctttggcgttgggatatctgttaattcatgggtttgttcttcgctaaactcttcatcgataatttctttacataaatcgatacattcattacagatataaacgccggggccagccacgatctttttaacttgatcttgtgatttaccacaaaatgagcagttcacagggccgtttgtctcggtattttcaaacattcattctcacctcatcgatgtatttacatggattaatcataacagaaaaactgagctaaaaccagcttaggcactgtcttctacgtccactactataacatggacgaacctaaacccgaaattatctgttcaatcatccggctaaccactttgaaaaccgaatgattctcgcagtaaatcacaggcgtcagccaaatagctattaaattaatcttacgattagctgacgctatgtaaaagggtctcggaagaattattcttccaagaccctcgacttgtatctaattgaattaattagttcttgtcgctgtcgtcttttttgtcttctgctttggcattttgcttagcagaatccgcaatcaagtcaacggcttggcgaatcgcaatgtcatgtgacaacatgtcatccgttaaagcaccacgaacagcactttcttccatgttgtattgactagctaaatccttaacttcggccgcaatttcatcctgagatggcttgatgttttcagcttcaacaaccgcttctaagaccaagttagtcttaacccggcgttcagcatcagcagcaaattgcttgtgcaagtcgtcttcagtagtaccagtcaacttgtagtaagtctttggatcgataccttgttgttgcatattagccaagtattgatccatttgacgatgaatatcgtcttctttcatggcatcaggaattgcttgaatttcagcattgtcaaccgcttggtttaaagcttcgtcttcaattgcatcatgcgcagcggattccttttgttccttaagttcgtccttgatcttagcttttaattcttcaagtgtgtcaacatcttcgtcaacatccttggcaaattcgtcatctaattcagggagttccttagtcttgacttcatgaactgtcactttgaaagtggcttctttgtcttgtaagtcttcagcttggtaatccttagggaacgttaccttaacttcagtttcgtcgccagccttgacaccaactaattggtcttcaaaaccagggatgaatgagttagaacctaattcaagtgagtagttttctgattcgccaccttcaaatggttcgccatcaacgaatcctttgaaatcaataaccaccgtatcgcccttagcggctggttggtcttccttcagaactaattcagcttgtttttcacgccgtgattctaattcggcatcaacatccttagcataaacgcgagtattttgacgcgttacactaagttccttgtattgaccaagcttaacttctggtttaaccgttacaacggcctttaatacccaaggcttacctttttccatgctatcaacatcgatttgaggttgatcaactggttcgatttcagtttccttgattgcttcttcatatgcctctgggagcacgatgtttaaagcatcttgataaagtgcttcttcaccatacatttgattgaagatttgacgtggaaccttacccttacggaaaccaggaacatttaagttctttttagtccgttggaaggccttgtcgataccttcactaattttatcagcaccaatttcgaatgttaattcgccttggttgccttctttcttttcccactttgcagccattgtattccctccgaaacattataatttctacaattctagtcaattgcatacttgttaagtttaacctatcgacaccgtaaagtaaaccaaattggctaaaaaagcgcgtaagctcgcgatttattgttcgtttttcttaaaaaaagcgacttggaagaagacttccaagtcgcttagatcaatcaatgaaaatcagttagagattagtcatcaatttctgaaacaacaccggcaccaacagtatgaccaccttcacgaaccgtgaacttggtacccttttcgatggcagctggttgaatcaattcaacagtgaacgttacgttgtcaccaggcataaccatttcaacgccgtctggcaattcaataacaccagtgatatcagtggtgtggaagtagaattgtggacgatagtttgagaagaatggcgtatgacggccaccttcttctttgctcaagatataaacttcacccttgaacttcttgtgagtttggatcgaacctggcttagccaaaacttggccacgaacaacttgttcacggttaacaccacgtaataacgcaccaacgttatccccggcttcacctaagtcaagtgtcttacggaacatttcaagacccgtaacagttgacttaagaacatcttcgtgtaaaccaacgatttcaacttcgtcgccgaccttaacagtcccacgatcgatacgaccagaagcaacagtcccacgaccagtgattgagaagacgtcttcaacaggcatcaagaaaggcttttcagtatcacgaactggagttgggatgtattcatcaacaacatccattaagtgcatgataaccttttcttgttctgggtcgccttcaagtgctttaagcgctgaaccacggataacaggaatatcgtcaccagggaaatcgtattctgaaagtaattcacgtacttccatttcaaccaagtcaactaattcgtcatcgtcaacaagatcagtcttgtttaagaagacaacgatatagtcaacaccaacttggcgagccaagaggatgtgttcacgcgtttgtggcataggaccatcagttgcggcaacaactaagatcgcaccgtccatttgagcggcaccagtaatcatgttcttaacgtagtcagcatgtcctggggcatcgatatgagcgtagtgacgcttttcagtttcgtattcaacgtgggcagtgttgatagtaataccacgttcacgttcttccggagcagcatcgatagaagcaaagtcttgttctttagccaagcccttagatgctaataccttagtgattgcagcggtcaaagtagtcttcccatggtcaacgtggccaatagtaccaatgtttacatggggttttgttctttcataatgttcttttgccattaatgaaacctcctgtgattttcgcaagaataacgtcgaggccaaaatggtctcaacaattctttagttagtattatactacatcctagtgaaaaggccaaatcgcgcacccatcactgagaatccttaaatattatatatagcctaatctgatttgtaaacagatattattcaaaaaattgaatttttgttagtaaattcttattacgcacgcttatgattgtaaatcaaggctaaattgctgaattttttgctgaattttcatcattttttcagtttggtcatcagacggcgttatcgtctgcccagtttgcaaactaatcaaaagatcgatccaagccgtggaatctgtaataacctgtgcagcgcatggatataaatacattaattgcaattgtaaaaggtctcgtaagctttcatataaaaagacatcttgattaccaagtcgcactttcaaagcatggtaaacggccttgctcgtctcgtcctgaccgagtgcgactaactttgctggacacagtgtcaacatcttctcatccagtagccactgcatcttgaccgtctctgatacttgcaattggtacagtgtatataacacttctactcgtgttaagggatgcaaaaacggatctactaatagaaacttggctgccgtcagatagtgctcatatggcaggtgacgggctgcttgcaaacctgccacctgtttctggacgggctggtcagataaatgataaaaatgacgcattgttgtggtcaatgtcgatcctagcgttcgctcagccgtactctccgccgcttttaaaattgtgcttgcagccgtagtccacgcactcgttgggcgtgccttgatcataatgtgggcagaaatgaagtcatgattagcaaccaatgcattcagatacagatctgcggccgcatcggttgctaaatactgcgcttcaaactcactggcataattagctgctgccacatattgttgatcagcaaccaacgcttggaccaattcgtaattaactggtgccgtttgctgtgcctgatacacttgctcccacaaactagccgccttggaccaatcctgagctcgactggcttgttcggcggccaattgtgtttcagctattgtcattgaaccttcctcctcttcattgtaaccaaaaaagtcggaagtagcttccgacttttttaatactaagctttagattcagtctcgactggtttggctggtttagccttctttgtacgccgatgatgctgattaacttccataataaccggtaaaataactgggtgccgcttggtctggtcccataaataatggttcaacttctcacggacagcctgttttaaatggccccaatcaaactctttattatcgagattttcttgcaccgtcgttttgactaactcagcgctctcttgcatcaagtctttactagtcttgacgtagacgaagccccgtgaagtaatcttaggagtcgcaataatcttcttctttttgcgatcaatcgtgaccactgccacgaaaataccgtcttcagacaaaatcttgcggtcacgtaacacaatgttcccaatgtcaccgaccccgatgccatcgatcatcgtatcgccgacttcgattgaaccggccaagtgcatggtatcaccgtcataacgtaactggtcacccttggctgcgatcaggacatggtcgtccggaattccaacttcacgtgcaaagtccgcatgagcatccaacagacgatactccccttgaatcggaatgaaatattggggcttcatcatgttgatcatcatttgcaagtcacgtttagcggcatggccggaggaattcatttcatcagcaatcgccttaacgtccgcatcagcacgatagatcatatcacgggtcttggcaaccacggtttccatcgaatgtgacggtgtggtagtaataaataccagatcacccttttcgatattgaccttgctctcctgcttattagccatccgttgtaaggccttaataggttcgcccattcggcccgtttgtaaaatcacgatttgttcaggtttaagtttatcaatggctttaagtggcacgacaacgtcttcaggcatgtgtaactttcctaaatcgattgcggtcttcacgatactctcaacgtcaccaggcattaaagcgactttccgattagactttgcagcggcatctaaaacttgctgaatacgcaagatattggatgcaactgaagcgacaatgatccgtcctggatgatatttaaacgtttctaaaacataggccgcaatttcacgttcactgaccggctgttcataattttctgcattagctgaatcactaagtaacgccaagacgccttttgatccaatctccgccaaccgcgcaaaattagtctgatagtcgcctgcggccgtcggatcaaacttaaagtcaccggtataaacgacctcaccggcactggtttgcaacacgattcccattgaatctggaatcgaatgggtcgtgcggaaaaacgaaaccgtgaccgtgccaaaatcaatttctgtcttctcattaatgatgtggaagtcattaaagtttttagctttagggtccttttgcaattgaatttttgccaactcaatggttagctctgaaccaaacacgggaacgttgaactcattcaaaaagtacggtaacgcaccaatggcatcagcgtggccgtgggtcaaaaagacaccgacgattcgatcagcattttctcgcaaataactgaagtccggaatcacgatatcaattcctaataactcattttctgggtactttaacccacaatctaaaatataaatatcaccatcgacttcgacagcatacatgtttttgccgttctcacggaccccaccaaatggggtaatttgaatttcactactcaattatttcaccttgattcttctaaatgtttaatgttttaaaaagctgagccgtttgttcagtactcaatggtaagattggtaaccgtggttcacccaccggctgacccaaatgatttaaggccgctttaactggcgatggcgatggtgcactaaacaaggcactcatcttgggtgttaagtcccgttgatacttagcggccgtggcaatctcaccctggtcgatggcactaaacatcgccgtcatttcgtcaccatagatatgacttgccactgagataaccccagcaccaccaatttccttggcagccaaactctgagaatcttcaccagtataaacaagaaaatcagccggtgcattttcgacaatcgcaccaaactcttccatcgtcgcacactgcttaatcccaataatattgggattttgtgctaatgttaagatcgtggccacggtcatcttcacaataacccggcccggaatattataaataataactggtaagccaccttgatcagcaaccgctgtaaagtgggcaatcataccagcttgatcaggcttgttgtagtagggaaccaccactaaagctgcatcaatccccttaatctgactaaccttcttagtaaatgcgatggtagcagcggtactgtttgagccggtcccggccacgattggtacccgaccatcgacaatctcagctgctttctttagtaaggttaatttttcatcttcggttagcgttggtgcttcaccagttgtcccacccaccagaataccttgggtgccgtgtgccaataaatgttcaatcaaacttgctaaccgcttttcgtccaattgttggtgatcatcgaaaggggtcaccattgcggtcatcaaatcaacgtttgcaaagttcatgatctaaaaactcctctattaaaatttacaagtaccagcgtacctgttccgattaagtaactctccccagtttaccacattttaaagtaaagcaatagttagaccattcaatgcaatctaatgtggtcgttgctgactaaaatacgcgacccacagcatcaatgccatcagctgtaatccagccgtaacaataaagattgactgatacccccaccaattggcaacaatcacggctaacccggggccgaccacgttaccacaagcttgcgcggactgatttaaactaaacacacgcccaaacgctgcgtgtgggacatgctcgactgtcatcacttgaagcgcgggcaatagtgccgcatccgcaattcccagtattagccgtagcccgaccagccacgcgacctgatgtaccaaactagtcaacaataagtcaacaatcgctaaaatcaaaaaagtaactaagcaacggccagcgcccagccgatccagaatgcgcccaacacgaccagccattagaatcgtggcaagtcccggcgcagccgccacaatccccgtcatcaagataatcgtctgcgccgttgcttggggcactaactgtccgaccagcaagcttaacagtggtgttatcgcattggtcgtcgcctgaacaactagtaacgatgtcagcaaggcacaaataaagcgaccacccaattgatgtaagattggtcgcaatggtggtaacgtggcgcgactaactgccgtcaccttctcttgaacaccccaccaggtcatgacaaagacaagcgccatcaaactactggtagccacgaacgccccccgatagccaacggtattagccagcaagcttcccaaaagtggccccatcaatgtgccactgatgctaccagtgaccagtttacttaaccactggccacgttgttccgcaggtacggtaatcgaaatcagtgcgttagcattattgatgtaacctgaaaacgctccctgtgcggctcgtaaaatcaagaggacgatcacgttaggtgctagtcccacaccgagaatcgttaaggtcatcatgccagatgcgcgtagacacatcagcttacgccccttttgatccgccaatcggccccacaatggtgcgactaaagctttgcaggcgtatgtcacggcaaacgccgctgcccctagaaaattcaactgggtcgttgaataatcgcctaatgtctgaatatacagcacaataaacggtaacgtcattgcgttacctaaatcagtgattaaactgccaaaccataagacccgaaagttacaagtcaacgttgccattgcttccatgaaatcccctcattcacttttgaataaacataagtatagcgaacggttgtttgggtttaataaagtttatgtatcgtttctgtaattttttacggcgaatttacaattgaaatgcaacacaaagtaaaaaaataaacccataccgggtagaatatgtttaacgaccaaatcaaacaattcgaggtatccggtatgagctataaacatcttactataaaagaacgtgaaatacttatgtttttacgagctaaggggttatctatccgggctgttgcgttacggctggggcgaaatccaagcactatttcacgggagttaaaacgttgtgcaggtaattattccccaagcaaagcagataatgactatcatcaaaagtggcagaattgtcacaagaagcggctattagacagccatccacaattacgccgtcaaattgttcattgcatcttagatctgcactggtcaccagagcagattaccgctcgctttaataaggaacatcaatggtgtgttagctacaacacaatttaccgtcatatctatcaacacaatttaggtgagaagtactcctcacgtggtgataccggtattcagcgccatctcagacataaacatcggactcggcattcaaagaatactagacgacatcgagaagtacagaccgactatatctcgatccatgagcgccctggttttatcaaccagcgtcaacgtataggtgactgggaaattgatactgtgattggtcgaacgggtcactccatccttttaacggttgtcgatcggcttagttgaactgttaggggccattcctaaagaatttgttcattctattacaccagatcatgggaccgaatttcttcatcttgatgaaatcagcgaaaggttaggtgttactgtctattggcccgatccatattcgcctgaacagcgtggaacaaatgagaatacaaatggattaatccgggaatattttcccaagcgaacagatattgataattatacagaacaggacgttgaacactgccaaaagcagttaaatcaacgtcctcgcaaagtgttaaactatgaaaccccatatgaagtattttttgacaaaccgttgcacttagtttgacaattcgccacacaaaaaaagaaccacccgcaggcagttctcgtaatctcaatattaacgacgaagaccaagactttggattaagtcacggtaacggttaacgtcttctttacgaaggtaagctaacaagttacgacggtgaccaattttcttcatcaacccacgttgtgaatgaaaatccttcttgtgaactcgtaaatgttcgtttaattcgttgatgtcttccgttaaaactgcaacttggacttcaacagaaccagtatcgccttcgtgacgagcatacttgttaataagctccgtcttcttttcgcgtgaaattgccatgtgtttcaaccacctttccaataattgccctaaactgagtaaatcgttggtggtgcacgaaaaactaagtaaagggttgctgaacacttgatatagtctagcaaactaaggagtaaaaagcaagtttcaatacatatcaagataaattactttacacataacggttgcattcaagccggggcttatgtataatagcatttgttgaaaaaatgatggaggtgaatctgatgccaattatcaaatccgctattgaacgcgtgaaaacaaacaataaagcaaacgtccgtaacaccgcccaaatgagtgcgatgcggactgctgttaaaaaatttgaagctgctaaaactgctggtgccgacaacgtcgacgatttatacttagcagcaactagcgccgttgacaaggctgcttctaaaggtcttatcaagcgcaacaaagctgcccgtgacaagtcacggatggctgcacgttacgctaaataagctaattttacgcccgagcattgcgacggcgtttttttatcgcctttaatgactcaaaagatggtcgaccgaattctgagaattccggtcgaccatctttttttgggctccatatctaagcactattacttttgccttcgtgaatagtcgttctcgcttgtccaacaagccaatgcctaacgggacagccgcgttccgaccgctgactgtcgctcattaacaaattgaaccataaataactcaaagagcaactccgggtcgcgttgtgtcgttttcatttgtacttctgtttggagcagtcctaagtacgccgcccgtaacgcagcttgatcaaaatggcggaccgtttgcatggctagtttgacccgatatgggtgcactttaagcgtgctagctaggctgccctgactatagcctgcacgcgccataattttgacctgtagcaacaatcggaattgtcctaataagattgcattgatctttagtggggcttcctgagctgccaccagttcatggtaaagttcgaccgctgactgcgtctgataacgaagtacatcgttgactaaatcaaaaacattttgcgtcagtgatttagtcaccaaagcctgaactgccgctaaatcaattcgttgggattgggctgcgtaaatcatcaacttcggtaattgtcccataatcagtcccaactgcccgtcagttcgattaaccagttcctgtagtgcgtccgcatcaatgcgaatctgtttctcatctaacgccgcttgcacatagcgttgcgtttcagcctccgagacttggttgacttcaaccgtcatcgcctgtttttttaacgttttaacgagctttttacgcgcatctaatttctcatagggtgccataaacaccagaatcgtacttggttccggttgttcaaaatagtgctgtagtgaggccagatcatggtcaaccttggtcttcttattttcaaccgtcaaaaagtacgggtgattaataaagactaatcgccgttcaccaaaaaacggtgccgacattgcatcatctaaagccacagctactggcgtcgtttccatatcataactgccgacgttcatcgtttgttcttcactgggaatttgctgcgtaaaagcctgtttgagctgatcggccaaatagtcgaccgttcccaagataacatagatcgatgccaagtcaccgttgcgaatcgattttaacgcctgttgtgcgttgatggcgatcaccttcctttaaaaatgtttgccaacgtccctggcgatgattaacgaaacgataggttatcatcccctgcaaagccgttgaataagtgacaatatgctgttcagctagagttattagtgtttcttgattcggatgcccatagcgattgtgccgacccaccgataaaataccgtggtgcacacctaattggcgcaaagctaacggatccgaggctgttttactgccatgatgccctagctttaaaacgtccacgcgtaattgtggatatcgggcaacgattgcacgctcccccgctcggtcaagatcacccgtaaacatgaaacgttgctgaccaaaaacccccgttagcaccaacgaatcttcattttcagcccgtcccggtttaaacggatgcaccgcaaccaatccatctgcaaacgtatggccggccaatgcttcaaccacttgattgaccggcatcaagcgtaatagttcacccaaatcaccaatatggtcaacatccttgtgtgataaataaactgtatccaagtgagtgatccctagccggtgcaaataattgaccgtaatcgtttccgcacgcgatcgcggttgtacctgctctgcctgccaacgtggccgggaaaagtgtagttgccccccagtatcgatcaaactcacttggcggttaaatggttggcgaatcaagatcgaatcgccctgaccgacatcgataaattgaacggcaccgtgaagtggaaaacgtagactaagactaaaacaagcatatgccagtaacagtcgccagtaataccgacgccgcggtgtccgtaacaaccacaaactcaatagactgagcgtccatgcccacagtgtactcggttgaccgataatgagtaggcctggccaatggctgacccactcaagccaattctgaaaattaaccaacacccattcacacacgctggtgacattggtagaaccaaagccaatgctcgcccccacgaccgtcaccggtaataatacccaactaaaaataggcgcaaccaccaaattgactgctaaggaccacagatgccactgcgccgtagctacaagcaaaaccggtaaactgataacctgaatccaaattgctaatcgccacggcggcaaaccaggcattaagatcagcagcaaggctagtccataactgagctgaccacctaattggctcaataccaaaggattatgggcaatccccattatcagggcaaggctccaaccacccaacgccccacttgactgatgtgttagcaactgccaaataattggtaaagccgcggttacaactgcccgccgcaagctatcggcaccgccgcccaagacaaggtatgctggcaagagccctaataaccaaatatcgattgcttgctgacttagatgcagtcgtaacaagacccattgcaagaatttaactaataaaataacatgcatacccgacaaactgaacaaatgcaatagtcccagctgttgaacggcccccattgtcgtctgaaaatctgtggggcgtatcccaaccagtagactcgtcgcataacgactaagcgttggtggcaatctttgacaggctagaaagaattgctgacgccattggtgtaatcgatcaagtagccccagccaaccacgccgcgacgcaatttctattcgttgaaccgctgtgaccgttacttggcgggcgatgccttgactgcgataatacctaggcgcattaaactgccccgggttggtaggaggtgcgatggcggcgacttccccctgaacgtgccagatcgtccggtgagtaaactgggtcagatactgtttttcagtggcacttttcagctgtcctctaacaagtactttgcccattggactagtggcaatcagctgatactgaccaccgcgcaccgtaatcgcagcgggttggacagccaaatggcttgtgaccacctgactgggccgctgaacaatggaggcgaaacggtggttttgccagttcagccagattgccaaagataaaacacagccaatcgtcaccatcaaacactgtcgatctcgtaatcggatgactcgcaataaccaaattaataataatccggctgccagccattgttggtcaactaaccaactactaagtaagccgcacgcaatggcagcaaaaaatagtgcacgcaattagtcacgatctaacaagatttgatcaagattcagcttatccaaatctgattggtcgaactgaacttgttgtaaagccacgtgttttcgttcaattaaggacatggcatacgcatcgttatgataattacgtaaataatgaattttttgaattccagcttgtaataacattttcgtgcattgtaaacatggaaagtcagtgacatagatttcagcaccatccgtagctgcaccgaatttcgcacactgcaaaatcgcattcatttccgcgtgaatagtgcgaacacagtgcccatcaacaaggtaacacccctcatcgatacaatgaacatcgccggatactgaaccattgtaaccacccgcaataatgcgtttgtcgcgaacaatcgtggcaccaaccgaaagccgctcacacgtgcttcgactcgccaataagaccgcctgcatcataaaatactgatcccatggaattcgttgatctttcatcattttatgcctcactttcaatgacagtagtataccaaaatgtgcgctttgaaactagacggtgagctggtctttgtatttggccacagtcttttctccaaagccactgacgtttttcaaatcatcaattgttttaaaattaccatgttgctggcgataatcaatgattttttcagctttcttctgcccgattccgctcaacgtttgcaacgcggccacatcagccgtgttgagattgaccttatccgttgccgcatgatcactagttggtgttccgccagtaggccccgttgactggacgactggtggcgcaacagccggggcctgttcgcccttagctggcacgtagatcacttgctgatcggttactttggcagccaagttgatctgccgagcatctgcctgtggctgcatgccttgtgccagttggatgacatccgcgacccgcatactagcagtaacctgatacaaccctggtttattaaccgcacccttaatatcgacatacccgggtgaactagcacctgttggtcgggctgggctcggtgtagcgttcgacggttgggtactcgttgcgggctggtcagcattggcagacgttcaactcgcgcctcccattgatgtggaattgaacgaatgtgccaacaaattatccgtaccggcgggttcaggctgcttaagttgactcagtgcccatcccgttatcaaaataatgatcacggcagtaacaccaccaacaatccgccagtgcattttgagcagcttaatacaatctatcatttgttttcaccccttcagcgaatagttacgcaaaaggagcggctgcccatgaaaaaagtttgggttttaccccaaactttgctaacttgcatttcaattttactattggtgtgtctgcaaataatgaacggcctgtttaaatgaggtcactggaacaactttcatattaggcgcgtactttttcgcggtcgctttagcaagttgatagttagtttgacccttttcttcaaccgccaaaagcgctttggttggtttcacatacggtgcaaagaaaattgtcgcccctgcccgcttagcagcaatcactttcttgtcgataccaccaatttcaccaacttgtccattttgatcgatggtgccggtccccgcaatcttccgtccgtgtcgcaaattctgattagtcaattgctgatagatttgcaagctaaacatcaatccggccgagggacccccgatttgtccgggatcaaccttaaccggaatagtcgtcgtcactttaatattatcagttaggccgataccaatcccggcgcggtgcgtgctcagcttgattaggggcgcacttgcttgcttcaagtggccctttcgccgatacgtgatcgtcactcgatgtccgacgccctgcttaccaatataatgctgatacgcactggctgtattaaaatggtggccatcgactttcgtaatcgtatcgccaacttttaactggtttctaaatttcgaattagactgaaccgttaaaacgtagataccctgataaaccttgcggtattgctgatgcgcagccgaatacgccgtcgcgatagcttcgttgattgcacttcgcatataaaacttctgaacccgattataagtcgcgtcatcctgaccgccagtcatatcctgagcactgaccacgtcatagtgcggattcaattgtgcgtaaagccacatcagcggcgtcgcccgagcttctgcgaccgaggtcaacataaacttaccccggtgatgatccggatgccgcttgacggtcacaaaagtcttcaaattgtttgcacttccgggtccttcaatatagtacggtaaaggaattagaaatagtgcaagtaccaccagtatcacgaccagcaagccccagtaacgttttaacaactcccggcccttagtcatgctgatcagttcctaaccgctgatggagtttttgcgccaccgcggtcgggacgtacttggaaacgtccgctcccatcttggcaacttccttaattaagctggaagaaaagtaagcgtacgggggccgtgcaatcaagcaaatcgtttcgattgtctcgtctaatgacttgttcatccaagcgatatcacgttcatatccgaagtcctgttcattccgcaaacctcgtaccaaaactgtcgcatggacactcgccataaagtcaacggtcaaaccagttgcggcctgaacttcaacgttggctaaatccgtcagctcatcactgatcatcgcgactttttccgtcatcgtaaataacggttgcttactcgtattgaccatgacggccacaatcaaccggtcaactaatcgactggcacgttgaatcatatccaagtggccccgtgtgattgggtcgaaactccccggaaaaactgctgtcaccataacttacccgacctccgttactttttggtaaatggtaatgaccgtaataccgtaatcttgttgtctgatcaactcaaatccgggtaagaccgttggcaagttcgcattcgtatccgtctcacaaatgatccggcaacccggattcagcaatcctagtgcatcacaatgctgaatatccttcacaatctgttgcttggcatagggtgggtctaaaaacacccaatcaaagtgttcatcttgggatgctaatcggtccaaaatacgctcagcatcgcctttgataacttcaaatcgttcgggggcttttgtaacggcaatgttatccttgatcgtcttgatggcttgatactgccgatcaatcaagacggcccgagccactccgcgtgatacagcttcgatactcaagccaccgctcccagcaaataagtctagggactgcccaccatcgaaataggggccaataatattaaaaacagcttctttaaccttgtccgtcgtcggccgagtttgcatgcctggcacggctttgagccgccgaccaccaaagtctcctgctacaattcgcatttcatcttcaccaacttaatcctcatcatcgtcatcaggcgcaccagtcgtggttggcttaaaaaagccttgatccacacgttcgccaaagttcattgcaacgtccgggcggtatgacggttcaaccctgcggacaaaatttaattttttgattttcgtggtcgcggccggaatttgactttcatccatgtacaagaccacataatgctctttacgcgattggtattgaattaatccaaaacgtttcaattgacgcacctgcttcatcgaatgcatataaacgatgagcgaccggcgcggtttaactgtaaaatccatcgaacctcacctcttctactagcgttgctgtttaaatgttaggctagattcagcatttcgtcaactaagttcttaactacgcagtggtttttattggcgaagcgctgaagctaaaaaacactagtaacctaagccactagtgtttttgcttgaaatatccttattgtggtgcaatctcgagcagcaagtcatccgtctgaatgacgtcacccgcattaacataaatatgttcgatgaccccatcttccggtgcctgaatggttgtctccatcttcattgcttccgtcacaagtaatggctcacccttcttaaccgtttggcccttcttaactaacagtttcagaactgaaccactcatcgttgcgccaacttcatcttcattagttggttccgccttgcgcgtgctggttgccgattggtgaatggcattgtccttgaccataatctcttgattttgaccattgatactaaagtaaagtgtccggacaccatcgacatcgggatcactaatctgattaagcttgacgatcatcgtcttacctttggctaactcaatattgaccgtctcaccgagccgcatgccttggaaaaaggtcggtgtgtctaacagtgatacgtgcccgtagcgcttatggctagcgtcgtaatccatgaatactttcggatacaggatgtagctgagcacttcctgatggctcgcttcatggtcaagcttagccgatagctctgctttgaccgcagcaaagtcagctggtttggctaaactaccgggccgcacagtcaacgctggctggcctttcaagacgatctgctggagcttctttggaaagcctccgactggttgaccaagattgccagcaaagaagttgatgaccgatgctgggaaatcgagcttggtaccctgattataaacatcgcccggtgtcaagtgattttccatcatgaacagggccatgtcaccaacaactttagagctgggcgtaactttgataatatcaccaaacatatcattgaccgtcgcatacatcgtcttaacttcttcccaacgatccccgagaccaacagccttagcttgttgctgcaagttagaatattgtccacccggcatctgcgtctgataaatatctgtctgtggtccggtcataccgttcgagaagtcttggtagtatggccgtacgccttgccaataccgattgatggcttcaacgttgttaatatcaacatcaggttgacgatcattgtgggctaatgcgtaatacaacgaactcattgatggttggctggtcgtgcctgatagcgcactcgcagcaacatcgaccacgtcaacaccagcttccactgctcgggcataggtaaagattccattaccagtcgtatcatgcgtatgcagatgaactggcacggacagcgcgtctttcaacgtcgatactaattcataggcggcctctggctttaacacacccgccatatccttgatggcaataatatcggcaccagttgattgtagatccaaggccagctgacggtaataatcaagattgtatttttgccgatcagggtccataatgtcgcccgtataacaaatcgtggcttccgcaatcttcccggtttccttgacggcctgaatactcttttccatttgaggaatccaattcaaactgtcaaaaatgcggaaaacatcaatgccactcttagctgcttctaagataaattcgcgaatcacattatctggatagttctggtaacccaccgcattggaaccacggaacaacatttggaagagtgtccggggcattgcctgccgaagttctttcagccgattccagggattttcatttagaaaacgataggccacatcgaacgtcgcaccaccccacatctcataggagaataactgtggcaacgctttttgtgaagccgcggcaacggctaacatatccttcgtccgcatccgcgttgcaaataaactctgatgcgcatcccgcatggtcgtatctgttaataatacttgcttctgggctaacaaccactgttgtaatccctggacaccttgttgatccaacacgtcttttgccgtgacgatgtcgggtgcgatcggttgaaaatcatccttaaactcaacgtccggatagtacttcttcgaatgttgggcaacgtcagcgaaaccattgaccgtcacatttccaatatacttcaacatcttatcttcacgttgcgtatcgtcagggaatttgaagagcgttggggtctgatcaataaaccgggtccccgcttcacctgcttggaacgttgggttgtcaatcacattcagcataaacggaatgttcgtcttcacgccgcgaatatcgaattcaactaggacgcgtcgcattttatgaacggccgctctgaagttccgcgccgcaacacaagcctttacaagcagtgaatcaaaataaggcgttacgattgcgccggaataggtattaccagcatccaaacgaaccccattaccacctggtgaccggtacgtctcgatgcgaccagtatctggcataaaatcatttgcgggatcttccgtcgtaattcgacactgaattgccgcacccttatatgtcaatgcgtcttgatgtggtaaccgtaaatcctcgaataggtcaccacccatcgcaattttgagctgagcatggacaatatcgatttcggtaatcatttctgtcaccgtatgttcaacttgaacccgcggattaacttccatgaagtagaattggtccccttcaaccaagaattcaaccgttgcggcgtttaaatagtgtacactcttcatcaagtcgactgcggcgttacagatcttttgacgcaactcgattggcagggccacggccggtgcaaattcaatcaccttttgattacggcgctgaacagaacagtcacgttcaaataaatgcatgacattgccgtgagcatccgctaaaatctggacttcaatgtgtttgggattcgcgatgaatttttccaagtaaatctcgtcatcgccaaaggattgcatggcctctgaacgggcacggtcaaaagcttcttgtaattcagaagcttcgtgaacgatgcgcattccccgaccgccaccacccatggcagctttgatcataattggataaccgtattgctgagtaaattgtaacgcctcgttcaggctagtaaccgggtgcaaggtactcggaatcgtctgcacgccggcatcgcgagccacacgtttggccgtaatcttatcaccaaacatctcgaggtgctctggcttaggaccaacgaaggtcatgccttcttcagcaatccgccgagcaaaagtagcattttcagataaaaagccgtaacctgggtgaatcgcatccacatgattttctttagcaatgcgaataatatcttcaatatccaggtaagccgcaatcggcgccttaccctcacctactaagtacgcttcatcagctttaaaacggtgaactgaaaactcatcttctttggcgtaaatcgcaacagtctgaaggcctaattcgtggcaagcacgaatgacccgggtcgcaatttcaccacggttagcaattaatactttcttcaccaaaatccctcatttccaaataaaatcgtcttagcctgcctgtcgaactgtattaaggcgcgccattttttcaagtgcactaatgtttaataccaatcctagtgaaagcgtcaataccatcatgctagaaccaccataactcatgaatgggaaggtcaccccagtaatcggaatcagaccaacgatcccacccacattaataaatgcttgaatggtcatgtaggctgcgacaccgtaacagaccaacgcgttgaacgtattagtcgcacgaaccccgatatagatcgtgcgcatcacgatgacaagtagtaagcccattacgattaaaatgccaattagtccgagttcttcggcagtgattgacataataaaatcagtgttcggttcgggtaaataaccacgtttttgcaaactattcccaatcccaacgcctgtcaaaccaccgtttgagatggcatagtaagagttgactaactgcgtccccgctcctgaagccgttttaaacggattcaggaaaccgagaaaccgccgtaactgataagaatttgcaaaagcactttggggcatgcgactcactaaaggcactaaaatccattcaaaggcagcgaccgccccagcaaagacaccaacacctacaaagtatgaaatgccactcgcaaacaaaataaccgccgcgatggctaaattaatcgtggccccaccaaggtcgggttgcacaaaaatcagtaaaatcatcgcgaacaacatcacaaactgagcacccaattcacggattcgagccaccccaaaatgtgcctcccgttgagaaataattgatgccaagtaaatgatcaggtaaaacttgcaaaattcagctggttggatcgagactggtcccaaaatgatccagccagccgccccattaattgattgaccaaccaatcggaggagaaccagaacaaataacatcgcaaaccctaacataccaagtaacttggtttgcttaaaatagtcgatcttcaaattcatacaaaccaaggtgatcactaagcctaagacgacccagatcagttgtttaactaaataaccggtgggtgtcgaaccgttttgtgcggctacgtatgaactcgatgaatagaccatgacaacgccgatcccgctgagaatcaaatacgggataaacagcacatagtccatatagtgtaactttttccacatgagcttaaatcccaccctaattaatatctcaattcgggttatcccccacaataacgcgaactgtttgcttgcaacaattatagcataagtcgattttaacacagcattttcacatattaatttgttgttttttaatcaagtttggattactgatttacaaactagtgcgtttagcctcattagtaaccggctggccaacgcctccaaatcagtgtatttcccttaataaacgtacctagacgatttgaacaacccgcgccgttccggcacttgacgtcggaatgaatttatcgcgcattgccacccataacgcgataagcgcccccgcaagagccaacaatcgacaacgtgaacgataaaatagccgtggtaagccccatttaggacccaccacagctattttggattgctaaccgctcgttaacgatcaatttcgtgtcacgcactgggacgattgcacgctcactcggcctcatctgccgcaatcgcggctcgcaacttacgctgataccaatccctaacacgctggatattcgcaactgcccgttcaaatgagaatgcgcccagtaatagcaggcacggtaagtactgaattaagtaccgactccgaccaccttcgaacaagaggaggaagataaacccaccaatcatcgccaaccggagcaattgaatcaattgccagcgcgggccaaaacccaacgcgataattacgagtagtactaaccaccacagttgcgccacaaaccgaaaatctgcaatatggcgaccgtataaataaataaagttttttaaccaattactaaagccctggttgcttggtttttgattttcgcgaaagaaattgccttccttcaaccagccaaaggtcccgtcagcagtattattgcgttgcttttttaccaagaattcaaggtaaccccacggtcccagtttcttgagctgacgcttcagcatcttgattgagtaagccgttttttgtgccttggtgggcaaaacggccatctgtatcgcctgcttttcactatacccgccggagccgtaaacgcccatggccataaaatgaatcgccggaatcgaccttgatttatcgattttgatatacgtctggttctggatggcctgattcgtataatgataagtgaggccggcactttcgagcatcaagattgccatggcgaccgtcacaaaaatcatcgtcgtttgtgaaccctgccgcgaccgcaaacgtgctaaaaagctgatgatggcaatggcgattaccggaataatggatgagggtttcatgaagtacgttaatgtcacgctcacgccaaacccaacggcggcggccacacgcagtaacggcggtcgcttcgtttgactcatcacaaaatagcacagcatgaaaaacgaaaccagcggcagtccccaagcatccgtatacggcataataatacttggaaaaaccgctaaccaaccagcgtgcagatacatagcgattcctaacgccgagcgtcgtaccacaaatacgctcattaaattgaaagctgctgaaagatcgacaaaaaacagcgtcacgtaatcaaaaaattgccatgaagtttgaccagtcacttccgatagccagtgcataaaaagcatgattggcatgttgttttgattaagactgtaatacgccgtcacgcccacctcctggacgtgtttcgcactggtagccgcatagtggagcatcccagcgtcaaaaccactgacgggatggacaaatgtcacgaatacgagctgaccaataaaaacgagtgctaacaagacaccagccgtccagagctgatttgtgattaatagtcgatatagcacccgatgaacgcgcggatacgcatagttcataatcaacacggcgacaatcacaataatcaaccccgtcgtcaataaggtcgtactcgtcccaaacgtctcgttatcccctaaaataatattcggcgacattactgcaaataacaacattggtgcaaatagtaaccaccaaacgctcgtaatcatcttctgactaaattgataaaaataacatctcatcattaatctacttcgtttgaattcttgcacctgaactaaacaatcaagatattccgccaacttcgcgtgatatcttgtagtcagccaacacgtgccgcttcaactcattttcctttccggcgtcgatagtgattgtgaattgtacgcctatcatcacgtaagacggccaacaatcgttgccattcttcggtgaacccccgcattttccaagttgtctgggtcgtcatcgcattgataacaccaatcaatcgaatccaagctgtcaaaaacatataaagtggcagcgttaatgttagccaccataaatgcttgtagaaatggcgttcttcaggatacggctttaataaaataccaacactaataaagttaataacccctaccatgacgtataaactatagatcaagagatatgagagccccacgaccacagttgaatagccaaaagcaatcaaaacaatcgtcgcaaaagtccaaatcattcgtggaaacgtaaacgtgtgatcaatcataattcgccgcaccaaaaattctttgaaaaagcccttgatgctagctgtttgtgacatataatgttgtgcaacttccagttcaccacgttgccagcgctggcgttgcgtatataactcggaaaagcctgaaattggcgctacataaaaaatagcatctgcacaaataacgacctttttgcctaaacgtgtccgaatctgaaacgtcatgtccgtgtcctcaccgattgtatcggtgtcatacaagaaagtttccattaacacttcccgtcgaaatgccgagaaagctcctgacatggtaaacaactggtcgcggaacgactcgatggtacggccagaaagaaaagcctgtgcatattcgtaatactcatttttagccaacagccgatgccaccaaccatgaacttgcttaaccaagtttctttgtgggagcactgccccggtcatggccgcaatctgctcatcgttctcgaaccgtagtaccatatttttaatcgcgttgggttccaataaaccatcactatcaatattaatgacataactaccaatactctcgtaaatggccgcgttaagcgcgcgagctttccccttgtcagtattgacataccgtaaaaataaattaggaaacgcattttgggcgcgagcatacgccccaaaactatcatcggtactctgattattcgccaaaataatttgcatgcttttttatcatacgtttgatgatcgatggaacgaatgcagtcaaataacgtatcttcagaattataaaccggtacaatgatggttacccacggccacttagcaggcgctttaagccggggcatgtggcgatgtagtcgcattaacttagaacgtgtttagaatctnnnnnnnnnnagtatccaaacacgttcttaatagtcgacataattgccggaataatttccaccacgatcggcactaaggcccaggtaatccaaaaccccattctagtcagcgctaagtttatccagtacatcacaggattcgctccctccaatcaataaactgctgataaagtcctcgagctaactgtgaataggtaaaaacattgtaatataagacaatgaccagaacatagaacagtaaccgcccaatcactgaatgagccagaaagaatgtttgaccaccgccaaagtgaacaatcacaatcactacggacaggcgtaatacattaatcaagtaaatatacaacaatccaaaaacaccataaaacaccttttcacggcgctggtaagccgggtaaaaggctactagcgaaataaatgcgcacgtctcaatgattcccgagcattcataatcaatcgacatgattaccggattaccactattaataatgtagaccaggcccattttgaacataatactgcaccaaccggtaatatcactaaacagcgctaccccatgaatcacagcgtgggtaaaaaaccacacccaatacggacgactaattgccgtcaagataaaaaagagcccggcgcttcccacaatgaagtagaaggcagatagccgagcccttttgagcactgacagtccgtataaccatatcacaatccctagtaggatctttacattcatcgtacatcagtcctattaattagcttaccgacgcgcctaagccgccggtggttataaattgattgtcagtaaattaaatatcattagttcaatagttatcgattcaattcacatcgtgcaagttaatctatctttaatcatgattaaaacatgccaattttagattcctgttcatcagccggtgcgcgtcctatgnnnnnnnnnngaaatgcctggaagtcggcttaggacgaaccagcaaaacaagtttacaccaactcgtatctatttccagcgggtttaagctggctgcttctgaatttaaaggaacggcacgttttaatcgtggttaatgctaaataataacgagcacaacatgttatcaatcatcagttcttagtggtcggtaaatccgttgcagttaatcgacgccgcttgcggaatttaaagtatccccaagcaacgattacgacaccgacaccggaaattacgtacggaccagttgagccccggccacggtcattttttgattaccaatattcggattggacatcgtaatcgtttggccggtcatcgttgaaatatcgaacttgctcaagtccactcggaattcagcaatcgaatgtgaaccggcttgagaaacatacccgttgccgaccgtcccgtactgatggccctcattgtacttaccacccgtaaatgagacagctttgaccgccccgtcactttgcgagctaggcatctcattggaccacacgtaatacttctgaccaccaatgtcgaaattataatccccgtaaccgggaacctgtccatacttcatcttgacataaacgtagacgtactttccgtcactaaccattgccatataaccgttataaccctcggtcaaagtcacgttcttccaatcattaaagttaccatcgattttaatgttgagattatcattgtcattggctgcattattgtccgtcgtcgaggacgccttggaagagaccgtgcttttatcagtaattaccccagctgagctagttgctgaggaactggctgcactactggtgctagtcgtagaacttgaactagttgtagaattcgcatttgtacttgaactggtactactacttgagctagttgaagtcgccgtaattgttccaacagtgctagtcgtagagtcactaccgatattcggattgaccatcgaaatctgcttaccactcgcactgtcagttaatcctaacttggttaagtcaatctgaaattcggcataattatgcgaaccgtcgttggtcacatatcccgtcccgacagttccatactgagtaccatcgttccatttaccaccagttaatgtgaaggacttgaccgttcccgagctaacactacctgaaatattcttagaccaaatataatacgtcttaccatcaatagtgaaattatagtcgccatatcctggcacagcaccatttttcatcttgacgtaaacattgacatactggccagcactcgtgagtgccgtgtaaccattatagccctccgttaacgtcgcatctttccagtcgttcatcttgccatcaatggtgatgttggcgctagcatgcgctgcggtcgtcatttcaggattgatcattgttgcccccgttacccccaaaacgagcatgcctaagatcatcaacttattaatttttttcacgatgatcacacctcccaagttcaataccattttaacgggtaacgaagaccatcagactctttttaccctataaactaatactatactctggataacaatttatcaatcattatttccatactaaatgaacccaataaccattaatggggcaactatttgagttggtgattaaacgactcctcttcaaaccgctttggacgatacagccttaggcatgccagtaccaaaaaagcacgccctattaaggacgtgcttccaagcaaccaacttacttgttcattttacgctttttagcttctttttcacgggagttcgtgttcaaaatgcgtttccgcaagcgaacatgatctggcgtaatttcacagaattcatcactattcaagaattcaagcgattcttccaatgtcaaatgcgttggcgtcttgattgtcgccgtcaaatccttgttagaagaacgcacgttggtcatgttcttacccttagtaatgttaactgaaatgtcattttcgcggctgttttggcccacgatcataccttcatatacttcggtacctggatcaacaaaaatcgttccccggtcttcgattcccattgtggcgtatgtcgtagtcttaccctggttgattgaaaccaaagcaccgttacgacggcctgggttccagttaggaataactgggaggtattcagagaaagtatggttcatgattccgtaaccacgcgtcaatgaaaggaattcagttgaataaccgatcaagcctcgtgaaggtgctaagaaagtcaaccgggtttggttattaccagtactttccatgttcttcatttcagccttacgctttgataaggtatcaataattgaaccagtatattcgtctggcgtatcgatttgaacagattcaaatggttcgcaacgcttaccatcaatttcgcgatagataacttctggacgagatgcttgtagttcataaccttcacgccgtaacgtttcgattaagattgacaaatgcaattccccacgaccagaaacgacccatgaaccaggttcgtcagtatcatcgactcgaagtgaaacatcggtttcaagttcagccttcaaccgcatttcaagttgacgggcagttacgaacttaccttccttacccgcaaatggtgaggagttcgtaccgaaagtcatttgtaaagttggttcgtcaatccgtaagattggcaaagcttccggattagctgaatcagcgaccgtttcaccaacgttgatatcttccatcccagaaacagcaactaagtcaccggcgtgggcttcattgatttccaaacgttgaagaccaaagaacccaaacaacttagttacgcggaaattcttcttactaccatcgagtttcatgacagaaacactgtcaccaaccttgatcgtaccacggaagacccgaccgataccaacccgaccaacataatcgttgtagtctaataaggccacttggaattgtaaaggttcgtcagagttgtcaattggtgatgggatcgtcttgatgatcgtatcgaagattggttgcatcgtatgttcctgcttagcaggatctgattcataactagaagtcccatttaaagctgaaacatagaccactgggaagtctaattgtgattcgtcagcacctaattcgatgaagaggtctaacacttcgtcaacgacctcttcaggacgtgcaccggggcggtcgattttgttaataacaacgattggtgttaggtgttgttccaaagcttttttcaaaacaaaccgagtttgaggcatcgttccttcaaacgcatcaacaacgagtaataccccgtcaaccatgcgcatgattcgttcaacttcaccaccgaagtcagcatgtcctggtgtatctagaatgttaatttgtttgtcgccgtaacgtacggccgtgtttttcgaaaggatcgtgataccgcgttccttttcaatggcattagtgtccatcgcccgatcgtcaatctggacatgttcgtcaagggtatccgattgtttaagcatttcgttaaccaacgtcgttttaccgtggtcaacgtgggcaataatggcaatgttgcggatatcatctctaaatttcaaaattgatcttcctttcatccttcaaaattctgactatcttcgacagcagaaatcttacatatattaatacaatccgccgttactatcaagtcatagcttcaacttgaaaccttcataacgacgttttcagcggctttcatccattgacataaaaaaactgtgacatatgggtcacagtcccactacttactagacgattgccaaaattgagcgttgtgcgcggtttgtcgctatcagtacagcacccgatgataacatattaaccgggttgccgtcaactctagacacaaccaagccaaggctttccgcgagaacgcgaccagccgcaaaatcccatggtcgcaagtatgacaggtagccgaccagttcgcccgctaagacctggctaatttgaataccagcactacccataatccgtggtcccagtgatttggcaataatcgtctgcatattgaagcggtcttgaattagtaacggcgcactcgcaccaaacagccccgcactcagatcaacatccgcgggtgcagccagcaattcaccgttaagcgtgacgccgacttcaggaccaccagcatataatttattcgccatgacatcaaagatatatcccagtgttggtttaccgtcaacatacaagcccaccatcatcgcaaaatgattacgctgatgcacaaaattcatggtaccgtcgattgggtcaacgatccagacgtgaccattcatatcagtaacttggtcgccggttccttcctcagctaaaatcttcgccactggatccaaggctcgaatctgacgcaccaaaaaatcttcattgctatgatccacgttagtgaccaaatcacgccgactcgtcttctccgcaaccgtcaagcgggtgcccatcttcgccaacacttgcgctctcgcagtttgcatcacgacttgcattttctgatttaactgtttcaccacattcgtttgcacgttaagtcacctagtctcggtattgaaatcgctgcttgttagtttcctgagctgcgcgcattgtttgataaatccgataacctgaagcagcctcataatcacgagccagtcgtttttcttccgacttagccggaacgaccgtcttaaaatcacgataggctgccaacaggtctgctgtagcgattgttccttcattagcggcctcgatggcttgataaaaggtcgtaaccttaatgatctcggccgtggtccacgtctcatccagtggatattggtaattatcattgtgtttaggcatcttcatccaactcccccgccgtgacccggtcaagttcctcttgaacctggctcgcaatctcagcgtattctttctgctcttcatcagatagcaccatatccgccattcgtttgattccgttagcactaatcagtaccggtgatgataatccaaccagctggtcgtcatcgactggtgtttggatatttgtgacggtaccgataaacggtgtctgggcgtaaaacgcattgagcacttgtactaatgctaacacactcaaggtctgattagtaacaatcgtggggtcgtcgatctgctccgtcgctgcactcatttcgtccatcccaaaactaatatcctggttagccaaataagtcatcacgggcgccggcccaatatatgaacgactccatgagatcaggtgtgtcgccgcagttcccactacgaatgcgcggacatccgccgggccgacacttaattgctgacgtagtagttgctccaataaacgactctgcggcaaagtacccaatccgaccactttagaatgatcaatgccactgaaacgcgcagctaagacacttaaaaccgcatcattgctaccagccaaaataatttttccgttaaaaccagcgcccatcgcatcattcacaaacgcgcgaaatagcggcaaagtcgcctttaaatcaccactggcatcacggtcgcttgccaatggcactaaatttccaataatcaagctatctgcttgcgaataatccggcttagcttgcgccactagtgtaaactgacgacaagttaaactcgctgttaccagtgcttggtagcgcggcgcttcttcagcacccgttgcgaccactaatttcactggcaaatctttggcaattgcgactaatattaattgttgtacgaactcgaataatccccgaataattactgtattaatcatttcaatccctccaaccttcgataataattgtacctgagctgtcaatgaattcaagtaaatgttaataaaaagcttactcttttgtaacatttttgcgtaaccaattggtccacttccccccgaagcaaacacattttgatatgttattaatatagaccactacatgctaaaaagttagcaatttgaataacaacatccgcatcaggttcaaaggcgtcacttacggatcagctgagtaatgattaacaagactgaccttcattgcgcctgacagcgcgttaagttacgtttttacgtgactatcttgactggtacttcggtaatccatactgactgcaacatcctatgtaaaataaaagtttgagactcacgcctcaaacttttattaagccatcatccgctttagatgtgcgttgggtaacccatcgcttcatccgccgcttcttgaactacttcacctagggtcgggtgtggatgaatcgtcaaagcaaggtcttcgacattcatcccaccattgaccgcaacgcttaattcagaaatcaaatcactggcacctggtccggcaatttgggcgccgacaatggtgccttcgtccttcgtactgacaagacggaagaagccgtccatggcgttcaacgagattgcacgaccattaccagcaaatgggaacttcgacgtcttcacctgcaagccggcttcttcagcttcagccttcgtcatgccaactgttgccaattctggatcagtaaagcaaactgccggaattgaaacgtagtcgttcgccgtcttcttgccactgattgcaccagcagcaactttggcttcagcaaaagctttgtgtgccagcgcagcaccggcgacaatatctccgattgcgaaaatatcctcagcggccgtccgcccctgttcatcaacttcgatcaagccgcgcttcgttaacttgacgtcagtgtattccaagcccatgtcgtcagtattaggccgccgaccaaccgtgaccataacatagtcagcatgaatctcagtttctttcccgtcgacagcgtaggtaaccgtaacgccactatcatcttgttcggagtttttagccatcgcattagtaatgacatcaacccccttcttcttaaagctgttcaagacaagcttgaccatatctttttcgaagttaggtaagatttgcggtgtcccttcaagaatcgtcacgtgagcaccgaggttggcataggcaccagccaactcagaaccaatgtacccaccaccgataaccactaattctttaggcacttcgggcaaattcaagccacccgtcgagtcaacgacccgaccactgaacttgaagcccggaatttcaactggccgtgaaccagttgcgatgatcaaatgtttgaatttataagtctgaccagtatggtcaccattcatcacccgtaaggtatgattatcatgcatataggcttccccacggaccacttccaccttatgcttcttgagcagcatttcaacgccaccagtcaaccgatcaacaacttgatggtctttccagtcctgggtcactttaaaatccaacaccggatcctgaatatttttaataccaaagatcttactgtccttggcttcttgtagccgatgaccagcactgatcaaagcttttgatggaatacaaccaacgttaaggcagacaccaccgatatattccttttccaccacggtgactttttggccgagttccgcggcccgaatcgcagcgacgtaacccccagggcccgcgccgatgatcattgtatcgcgttcttcagcaaaatctcctacaaccattctgacctcatccttccatcaaaagtaattctggatcatgtaacaattgcttcaataagttcattgcccgttgtgctgttgcaccatcaatcagacggtgatcaaaactcaaggacaacttctgcatcttaccaacaacgatttcaccatcgtcattgacgtaaggttccttaccgatacgcccaacacctaaaatggcaacttccggttggttgataactggggtaaaccagccgccaccaattgagccaatattactaatagtaatagacccaccactcatttcactggcctttaacttgccatcgtaagctttttgcgtattgtcagtaatttctttggcaattgcaaacaagcccttaccttcagcgtgcttaatatttggcactaacaatccacggtcagtatcggtagctaccccaatattgaagtagtgtttgtaaacaatttccttgtttgcatcatcgatcgacgcgttcaattctgggaattgttgtaaaaccgcaaccaaagctttcacgaagtatggtaagaaggtaagatggatgtcgcgatccaaagcaacttgcttgtacttcttccggtgtgccatcaacgcactcacttcaacttcatcaaataaagtaacatgtggcgcggtgtgtttactgttcaccatagccttagagattgccttccgaattggcgtcatcttttcacgcgtctctaattcaggtgtgtcagaaacatatggtttaactggtgttggtgctggtgcttcacttgcagccggagccgttgtcgctggcgtagctgccggtttagcacccgttgccgctggcgcacccgtgtaattgtcaatatcttgctttgtgatctgaccatgggcaccagttggcgtaactaacgtgatgtcaatgtccttatcacgtgcgtactggcgcactgatggcattgccaagacccgtttattaggattgcccgcagccggggttccagtcggttgtgctgatgttgcagcgggagtttcagctgcttcacttgccggggcttccgtcttagtagccgctggtgtttcagccttagccgctggcgcagcgtcgccagaaccatcgtcaatcgtgacgatcacatcaccaattttagccgtttcaccttctggaactaaaatatcaataactttaccacttactggcgatggtaattcttccaccgatttatcattttgaatttcaactagagaatcgtcttctttgacttcatcaccaggttttacgagccatgatgcaatttcgccttcttcaagaccttcaccaagctctggtaatttaaactcgtaagccattggataacttcctttcatgacagtctcaggtgactgtttttcgatgccgcgtcttgattaatagttcaagatttcgcgggtttttgcctcaatttcatcttcagctggtaaccaatcgtcttctgctaatccgaatgggtagaccgtatctggtgcgtacacccggccaactggggcactgagataaagcgcacctttttcagcaatcagtgaagcaacgttcgcagcaatcccagcctgtcgttgtgcttcttgaatcgcaacggcccgaccagtcttttgaacagacttgagaattgtttcttcatctaaaggtgacaaggtccgtaagtcaacaacttcaacggagatttcttctttttcgagcttttccgcaaccttcagtgactggttaacttgtgcactgtaagcaatcaaggaaatatcagtaccttcacgaaccacgtttgctttatctaacggaacggtataagcttcatccggaatatccgccttcattgaccggtataacttcaagttttcaaggaagaaaactggatcgttattccgaatagaagaaattaatagccccttggcatcgtaaggattagatggcgtcacgacccgcaaaccaggaatttgagctaaatagccttctaatgagtccgcgtgcatttctggtgtatgcgttccaccaccatatggtgatcgaatggtaatcggcatatgccgagtgccacctgtccggaaacgttcccgtgacatttgaccagcaattgaatccaaagtttcaaaaatgaatccaaggaattgaatttcagggattggccggaaaccttccaatgccagcccaattgataaaccgccaataccggattctgctaaaggagtgtcaaaaacacgatcttcaccaaattcggcttgcaggccatcagttgcccggaagaccccaccgtttttaccaacatcttcaccaaaaactaaggtcttttcgtctgacccgagttctaatcgaagtgcatcggtgatcgcttgaatatacgttttctttgacatgttacttcgactcctttgcttggaattccgtaatttgttgttgaatgttttgtggttgttcttcaaaaacattccccaagaattcggtcattttttgctttggtgcttcatctgcttgtttaacagcagccttgatatcttctttaacttgttcaacgtattcgttttcttgatcttctgaccaaacaccttgatcagtcaagtacttacggtaacgaatcaatggatcattatcgaaccaaggttgttcttcgtccttagtccggtaacgcttaggatcatccccagcattcgtatgcgggccaaaccggtatgtcagcgtttcaatcatgacaggaccgttgccagcagcagcgtattcccgggcggcctttgttacttcataaacagctaggaagtccatcccatcgacctgaacacttggaataccggcagcaactgctttttgagccaacgtcttcgcagctgtttgcttgcgccgtggtactgaaatggcataaccattgttttgaacaatgaagacggccggtgcttcgaaggctccggcaaagttcataccttcatagaagtcaccttgcgaagtcccaccatcaccagtataagtgtaggcaactttgtcttcggtaccgttctttttaatccctaaagccacaccggcagcttgtacgtattgagcgccgataataatctgtggtggcattgcatggaagtcttctggatattcgttacccaagacatgaccacgagaccacaggaacgctttgtaaacaggtagtccgtgttgaatcaattgtggaatatcacgataagcaggcattaaaacgtcggttttcttcatcgcggcgttactccccatctcactggcttcttggccctcagtcggcgcatagaatcctaagcgtccttgccgtgtcaaagcgttagaacgttgatgtaacgtccgttcccataacattaatttaaagaattcaacgagttgttcgtttgaatatttagagacaatttctggtttaattactttagcttgaccatccaatacttgcacgggctcaaagtctttcccaagtgcatcgcggatcgcaccaaaatcaacaattggtttttcgttgtccataaatgacacatccctttcatgaacgtacaaacgttgtgcatcgcaccgcgttcgtaatcgttttcataattacaagtctaatttaccattgcgtttcatcttttgcaagcccttccaaagagcgaaaagccggctttttctgtccaaatgattgtgaactatttaatttgtgcttaattctgttttcatctttttcataacgggcgctactttttggcgtaggcttatgataaactagatattaagtgtaaactgcgcgatcttaattttggaggtaattggaattgattaaaatgcgcgacattatccgcgaaggtaatcacacgttacgcgcggaagcaaagcaagttaaatttccgttgagtgaagctgatcagaagttggccaatgacatgatggaatacttagaaaacagccaggatcccgaattggctaaaaaatacggactgcgtgccggtgttggtttagctgcaccgcaagtcgacgtttcggaacagatggctgctgtccttgttccgagtgaaaatgaagatgatgaaccggtctttaaagacgtcattatcaatcccgtgatcatcagtcactccgtccaacccggcgccttaactgaaggtgaaggttgtttatccgtcgaccgtgatattgctggctacgttattcgacacgatcggattacgttacgctactataatatggctggtgaagagaaaaagattcgtctcaagaattatccggccattgtttgtcaacatgaaattgatcatcttcatggtattttattctacgaccatatcaatggcgacaatccatttgccgctgatgatgatttagttctaatttcttaaagtcatttaaaaaagcagtcctgaaatgttcaggactgcttttttggtgcactcgaattcaaccgacgcaaatcttccaaatactctaaagtggcctcattcatcaaataggcaatatctaagtggagctgtccgctgcgcagccacgcatcagtcactcgtaacgctggtccagcttcccgaaaagcaaccacctgattgtgaattgcgtacgcttgcaattcgttattgaataatcgccgaacttctggcaaatcggccgtgaccatgcctggtgcatctagcacgtactcaaaggccatcacaccacgcccccagacgtctgcgacgggcaccgaatgaatcgcccccgcaacctcttgaatcgtcatcgcatttgcgagcactttgaatgctgctaccatcgcactatcaaccgttcgttggccagcccgccgaatcttcaacgccgcacgcttcagcacttgccgtcgcagcaattcataaacgacgattgccattagtaccccaccaatgattgttaaccaactctgcatgctcaaccctcaattctttttttgtataatgattcacaattttaggaatttttcattttattacttatgtttagcatagcatgtttcatcaaaaaaaattcttttaaccgctctatttttgaagaaagttaacattgtatacacccatctcaaattatgctaaaatgtaagataattgttgtgtttacacaacctggtgtacggatcaaacttttatttttgctatctatttagattacttagtatctaaataaatcttgtttatattaaggagttttacgcatgatttacaaagtatattaccaagaaaccaaagaacggaacccacaacgggaaacgacccaatctttgtatctcgaagctgagaccgaagtagcggcacggaccttagtggaagataatacagatcacaacatcgaatttatcgaaccgttagaaggtaacttcttggattacgaacaaaaaaatccagagtatcacctaacggagttcaataaatgaaacggttaaacgtcaaaaataacgaaaccgctgtttttgcagtcggcggtttgggagaaattgggaaaaatacctatggtatccaatttcaagatgagattattctgattgatgccggaattaaattccctgaagatgaacttctcggaattgattacgttattccagactattcttatctagttgcaaatcagcaaaaaataaaagctttagtgattacgcacggtcatgaagatcatatcggtgggattccattcctattaaaacagatcaacgtgccaatctatgccggccccctagccttagccttgattaagggtaagttagaggaacacgggttattaaaaacaactgaattacacgagatcaatgaagatacggtgctcaagttccgtaagacgcgtgtctcgttcttcagaacgacccattcaattcctgatacactgggaatcgccgttcaaacaccacctggcacgattgtagaaaccggagactataagttcgatctgacaccaattactaaccagccgccgaaccttcaaaagatggcgcatctcggtgaacgtggtgtcttggcgctaatgtcagacagtactaacgccgaacggccaatctggacgaaatctgaacggtgggtggcgcaatcaattcgccacatttttgaacaagttgaaggtcgaatcatctttgctacctttgcttctaacatctcgcggattcaagaggcagcgcaagtcgcccttgaacatcatcgtaaaatcgcggtatttgggcgtagtatggaagcagctatcgtcaacggacgtgaattaggctatttaaacatccctgacgaagccatcgttgatgctaacgatttacgctccctccccgccaataaagtcatgattctatgtactggttcccagggtgaaccaatggcggcgctctcgcgaattgccaacggtactcatcgccagatttctattgaacctggcgacaccgtgatcttttcaagttcaccgattcctggtaatacgttaagtgttaaccacgtaatcaacgaactcgaagaagccggtgcgaatgtcattcatggtaaagtcaataacattcatacatctggtcatggtggtcaggaagaacagaaactgatgctacggctgatgaaaccaaagttctttatgccgattcacggtgaatatcgaatgttgaagattcacaccgaactggccgaacaatgtggtgtgccactagaccatagttttatccttgaaaatggtgatgtgcttgcctttacgaaggattctgcccgggttgccggtcactttggtgctggcgatgtctatgttgatggttctggaatcggcgatattggtaacgttgtgttacgcgaccgccaagtgctttcggaagaaggtttggttgttgtcgttgctaccatcaatttgaacaaaaaagagatccaagctggtccagatattctgtcacgtggttttgtctacatgcgcgagtctggcgatctaattaacgaagcccggcggcatgtcttccgtacgatccggcgcaaaatgaagtcggataaagcaaccgaagcgactatccgcaatgcgattattgacgacctgcagagtttcttatttgataagactgaacggcacccaatgattctgccaatgttgattatgaactaactacttgccggaacgatctcgttccggttttttatggtgtaagactgatatgaggtgtaattttgattgctgaatactacattattattaatgaactggcaggatctggtcacggtaaggtcgtttgggaaaccgtcaagccgattctagaacaacgacagattcgatttgaatatcgaatttctgaatatgccggccacacaattcggctcgcaaatgagtacgttaaaaccattcaacgacgaccaaacgtgaccccggtcattctggtcattggtggtgatggcacactgaacgaggccttgaatggtattatgcaggtcccacaagctgaaccgatcccgctcgcctacattcctggaggttcgggcaacgactttgctcgcggtctgggtatggcgactgatccagcaattgcacttgcacaagtactcaacaatatgcggccccgttcgttaaatgttggttatttccatgaaaccttgaaaaacgaacaccggtatttcgtcaacaacgttggtttaggatttgacgctcaaatcgttgatgacacaaaccgtagcaaaaagaagggccgtctgggtcgttgggcttatctcagtaacatgctggccgcatattcccaacaggaaggcttcccgctaaccgtacacgttaaccggaagcgagactattataagcgggctttcctttgtacagtctcgaacattccatactttggtggcggagttgaaattctgcctcaggctaatctgcacgatgatcagctcgaattaatcgttgtcgaagagcctcactggtggattatcctctggttgttcgtcttactgctactgggtggccgtcatctcaagtcgcgtttcgttcaccattatcgcaacgctaacttgcacttgttggttaactctgttgaaattggtcagatggatggtcaaattattgggaatcgtaactacgacctctacttgtccacccatccctacccattctggatcgacactagtatccatgaccaccactaactctactgctaaaacaatacaaattaacgataaaaagtcgttgcgaagatgctcgcaacgacttttttataggacccagattggcaattcatactacttgagcaccgtccacttaccggccagcaatgctaatgaccacttaattgactccccacccactcggctaataaaaaagactgctgaccatctcaatatggtcacacagtcagtcttgattaatcttagtcctcagaagcgttgattgcttccagaagcatgtcaagttgttcacatttacgagataagtgactcacccgttctttcaaatgcggataaatggtcacaacccgtgagcgatcctgttgccgaacggctagcgtccttaaatgatcgagttcggtattagcctcttgatattcttctagaatctcaaaacgattactcactgatagcacttccttatcacaatagatggtccaatttttcgaattgaaaaacgacaaacataatataccacaattattggtaagtttaaatcataaaattcaaaaaaatttaaataaaaatccccctaacacttaacaatatcgtgttagggggattagcaattaaaatcggcttacttaaccgtacctgcaaaacttggcatgaagtatgaactgattgtctgaacttgaacgttttggccttcagttggagccgcaacgtattgattatttccaatatagatggcatcgtgataagtgctaccacgactaccccagaataaaatatctccaggttgagcatccgcaacggaatgcgtcgtcacataagattcctgtgcaaccgtactatgtggcaaggtaatcccagctgcatgttggtaaacataggaaactaaaccagaacaatccattcccgaaagactcgcaccaccccaaacataagggatgttggcactagccaacttcagcgcaaggccggttacagaaccagtagctaaatcactcgttgaactagtagtggtactgctactattagtcgttgcggtactacttgcggtattgcttgcactgctagtggctgctgaagaactactctgactggtcgtgcttgaactagtcgctgccgagctactctggctcgctgtactcgtagttgatgctgcactagcagctgtacttgatgcttgactagctgtgctagtagcagtcttactgctagtactagttgcactcgcagttgaagcggtactttgactagtcgttgttgaactagcagctgatgaggacacgctactcgttactgaggcgctcgctgcaacactcttcgactgactggtagcagtcgaagaactagcactacttgctgatacggctgcactcgttgcgactgctttgaccggtgcatttgaggtcgtagccgttgatgaagcaatagagccggtcgatgatgatatcgttgacgtgctagtactgcttgctgagttcgcactgacagcatcctgacttgctgcactggtgctacttacaacgcttgcactcacacttgaaaccgaactcgcacttgtacttgaggtggaactcgcactaacagccgtcgtggccttggcagtcgtactcgtagttgacgctgcactagtagctgacacggttgttttttgactcgtcttagcggtcgtcttggtcgttgctcctggcacttgaatgttctgacccaccacaattaaatcgccagaaagaccatttaacgtctggagagcgtgaacagaagtgttgtacttatcagcaagcgcccaaagagtgtcacccgctttaacggtatatgtacccttagtagcggctttcttagttgctgacttagtcgtggcggtcttagttgcggatccaccaatttgtaagttttgaccaacataaattaaatcgatattaccatcagatgctttaatctggttaagtttttcaatactctgcacggaaacaccgtgttgttgagcgaggccccaaactgtatcgtttgcttttacagtgattgaggcagcattggcagcttggcctgtagcaagcaataaaccaacggcaccaaccgtactggctaggaccttgcccgttgtatgtgcttgtgacatttaattcactccttagtttttgaactcaaattaacagtaacaaaatcgtcttgtgactgaagattaagaaattcttaacctgcttttacaaatcataattttattgtagcacaatttaccaaaatacaaactagaatcgctcgtttttttacaaaacagtccggttattttaaaaaacgtttgccaatgccaaagcggcgtatttggctgttatagcaacgtttatgcatataaacggaatgttatcttttgattacttcaagtaattagttgcactgtttggacgagttacgctattcagtaaacgaacaaaaaagcacattaacctttttgtaggttaatgtgcttaaagttgcgagctagatgcgaggatcaaacaaccgatcaactggttgctgttcatgtactaatttgattgcatcacccaataatggaccaaccgaaagttgcaccaacttatcaaattgtttatccgctgggatctgaatcgtatccgtcacgatgactttctcgaacttggaagcctgtaatttagccactgcatcctgtgaaaagattgcgtgagtcgcacagccgtatacggtcgctgctcccgcttgtgctaaagcatctgccgagacatcgaaccgagttcccgtatcaatcatatcatcgatcacaatggcgacgcgccctttcacatcaccaataatactacttggcactaggtcatcatcatctgggtgtcgattatcaataatcgcaattggggcccccaatagttctgccatcttacgtgcccgcgaaacaccggcatgatctggtgacacgacgacgagattatcggtaatgccgcgatctttaaaataacttgccaagagtggggccgcaaataaatgatcaaccggaatatcaaagaatccttgaatctgtgcggcgtgcagatcgaccgtcaagactcgactggcccggtccttttccaataacgttgcaattaattttgcagtaatgggctcacgtgaacgcgctttgcgatcttgacgtgagtacccgtaataaggaataaccacgttaatttgactggcactagcacgtcttaaggcatcgatcatgatcaataattctaatattgtatcattgaccggttccgaaatagattgaatgacgaaaacttccgccccacgaatactttcttcgatgttgatctgaatttcaccatcactaaaccgctttacggaacttttgccgagtggaattccgacccgctgcgcaattttttcggctaacggtaggttcgaattcagggcaaacagtttcagtttggcataagattgatctgttgacataacgacctccataaaagttgtttgatgattttgctactttgattatagcagtaaccacggctaaaaaccgcacacaagcaaattttcttgcataatgagcgtcgccgacaatgtgtcgttcattgtaatttcagttgcaataaccaattaattatcaattagctacttgcagcatgaaattagctggcgtgataccattcatgccaatcatcggatcgattcggccagcgctgactagcgctggggtcaaaattgttggtccagcagactgggaactcggttcctgagttttttcagtggccgactcctcgtcagaagcaactttcttaaccgccgtcgctttttcgccggctggcattgcctctgcttggtcagtagtcgcaatagtggccgtttcatcggatacggtatccccgccaaagacttgttgtaaccgtttcgtcagtgtggtttggcgattaaccgattcattggtaacgctccgctcaaatgattgactatcacctaacaggatcagcatttgttcagcacgtgtcacggcagtatacagtagattgcgttgtagcatccgtgcaaattgtggtaccagtggcagaatcaccattttaaactggctcccttgagacttgtggatcgacatactgtacgctaatgtcaatcgattccattcattgcgttgataagtcacttcattttgatcaaaggcaatcgtgatctggtctttcttcgattcattgtgagaatcatttgccagatcgataccgacgattttaccaatgtcgccattaaaaacattatcctcgggtgaattaacgaggtgcaggaccttatcaccgacccgaaaatcttgaccgttatacgttagatgcttctgatgggcactcttcaacggattaaagattttctgaaccgtggtattcagctgatcgatcccggcagtgccgcgatacatcggggccagaatttggacctcctcagcactgaagcccttcgccttggcacgtgccacaacttgttcaacaatgtgattgacttgataagcgttgcaggcaataaatgagcgatccggttggttgacggcaaaatcggccggtaaatgaccatctttgatggcgtgggccaacggaataatactggaatcattgccctgccggtagattgtcgttaactcaatttggggcagttcactaaactgcaataaatcatgaaacacttgcccggctcctaccgatggcagttgatccttatcgccaacaagaatgacttgcatgtgacttggaatcgccgtcagtaactgctgaaacagtaccgtgtcaaccatcgacatttcgtcaataatcaggaggcccccatctaattccttactaggctcctcgggaccatcttcacgccccgtcaacccaagcaaccgatgaatagtactagctgggagcccagtcgtttcagccatccgcttggctgcccgtccagtcggtgccgccagcaggattggaaaaggcttatccttatactgattgatatctagtgcaacgtcgtgtaattccgcatagagcgcgactaagccacggataatggtcgttttaccagtccccggtcccccagttagtagaaaaacaggcgccgtaatcgccgcttttagtgcttcggtttgtgattcatcataagtaatgttgctagctcgaccgacatgctcgatagcatgatccacggcacgttcagacaatttttcatcattatcggcggctaacaaccgttgtaaatgttccgcaacgcgccactcggcttcatagaggccgcgcaagtagatacgattctcgtcacccacgattttattttccttcgccaagacgaccaactgatcagccagcttcgaaggatcaatttgaacattgcgagcattctcaagtagttgcaacgtttgattcagcaacggttgagccgtggtatacgtatcaccgttttccacgcacagctcattaatctcagtcaatagggccgcctttaaccggtcatccgcttggggatcaattttaagttgggccgcaatttgatccgcttttttgaacccgacgcctttgatatcctcaaccaaacagtacgggttctcttgaatcttagccaaagtgtcaccttgatagcgtgcatagatggccgcagctaaccgactcccaaaaccgtacgcattaagtccaatgatagtttgctccaaaccgttattgaccgtgagcgtgtcgatcaaagtcgtctgaacgctggcccgaagtccgattggttttaaaaccttcggatcagctaaaatttgatcaatggcatcttcgcccaaagtatcgacgattcgctcagcagtccgcttacccaacccaggaaaatcactaccagatagataggcaatcaagcctgcgcgtgtcgtgggcgtttcattttgataattatccgcttgaaactgaaccccgtatttgggatgcgtgaccgttttaccggtaaaacgatacgttgtctcctcctgaatatccgcaaaatttccagtaacaacgatctcatcttccgaccaatcaatgttctgttcagttactttgactaataagactttataaaaactatcggcactgctaaaaaaaacggcagcgactttaccgacgataaagtgtgtgaccggttcccgaccaatatcgtcggaaaataaatgtgcttgttcgtccgtcacggaaatcctcctaaattagtgattttgattatctgcttgtgcggctaacattttttcaatatccgttagctgttgctgatgacttttaaaatattgactgtccaatttctgcgcgcgttcaaaccaggtggcatacggtttccccagtaccattgcggtcagtccaaggttaaaagcagctcgcccagattgcgaatcaatcttatatgcgcgttgatagtaatccgatgcttgctgattattgcctaatgcaagtaatatgtctgctactaacaaattagcgtcaagttgttgtggacgtgcctcttgagccgtaatggcccagactagggcatgttggtaatcgtgttgggccattaaagcttgtgcactcattaaataagcatcctgttttagttgatcatccgtaatttgttgataatatggtaacgctttgtcataagtttgagcttgataatagacatttcccaacgcataacgcaggtagtcggctgcgggttgttggtggtcaaactttcccaacgccttcattgctaacgcctctgcctgttcaaaatcttgaccagccgttaataataccactagttcataataagcatggtagtcctcgggctgtgcatcaatcttgccaatgagttgatggactagtgcttgctgtttagctttgctaggacgtgatgtttttgccatccgaaccacttccttctatattaaatcgtatcagttgcatcgggccgccgtgataggtatgaggtgtcattccaatctaatagcttaaaatgttgaccacggtcacgcgtctctaaaattgttgttgacgtattcgacaagccaccccgttgccgtaacgtcgccagtgtcgctcccagtaatgagttgaccaaggcattcaaggccgcaccatgactaacgatcaaaacattgtcatcgcgacgtggatttgcttgaacaatttgcttaatagcgggagtcatccgcttcagcagttgttgaaagctctccccctgaatcgctgtcgggtcatactgatccggatgatttcgaaacgcgtcgaattcggccggatacgtagcttcaacatccgtgaaggccattccttccatcttaccgagattgaactcccgtaaacgactcagtaccgttatgggtaactctgattgtgtcaaatcattacgtagtgtcatcgctgtatcacgcgcccgttttaacggactgacatagatatgactaaaccgaatatcctggagcgccgctgccaattcatgaatttcttgataactagtcggtaataatggtgaatctccctgagagccttgatagcgcccctcaagattccactctgttttcccatggcgaacaaataatagttttgtcaattgcttacttccttactctagtgtcttgatttgatcttattttcgagcaatggcccctccaaactgaataacggttgcgatgattcagcagtatcattgcaactcatcgtcaatcgccgttaggccaaccctgttaatacttcaaatgacgtggcggatggtcgtgatacttcgtcacgctcgcaacacgtcttacgttctatattatgacagttttcagactgattttcaaaatctgttcacgaattttaacgatcatcacgctattatttgataaacacgatcagttgaccgggcatggtatcttttagccactaagtatgcaactgctacgccatactgccaatggctgttattcaccgtactactcagccgtaagagtaaatcgtcgtttttccaatctacttaataaaaatataattatgtaaactaaatcagccgaaccaagttcaactccagcattaccctgctttaacaaaaaagtggtaagtagctttgaaacactacttaccaccactaattattatgcagcgggcacaatcgccaaggtccaagtaataatgctttgatactcaccaggcgttgccaatggtgttgctggtaactgtaatgaactaggtgccacatcaaaagtttgactctgatgaccagtttgccggtaaacgctggttgtcgaaccatccgttggtatcgtttgattgagcactcccgtcgagtctttgagcattaaccgagccgtcttgattgttgtatttccagcagtaaagggactcagactcgccattaactgccagtcagccccaacagtccggtcatcaaccacggccaaccgatagtcattattaccgtcataaccgtcattagcttttacggccgtcgggtctgtcgccaagtcagtaccttgtgcgagtcgctgcaggtttaacgttccaaaattaaaattaggaacggcactcaatgataaccgcccaccactcttaactgttagcaaagcggcgttggtcgtcaccgtctgtggcttgccattgaccggatagcttagactcgcatagtaggccgttccatcatcatccgcattggtcggtaccttgaccgtataactcgtatccgtgacattgagggctgtagccttaccattcttgacacgataccaattgctaacagtcaccccctcgggcaatgctggtaatgtaaatgttgccggcgtcccttctacgaccgtcacatcttgtaacgctccaaccaaaattttgacgctatcactcagaccattagaggttccggtaatcgtgacagttccgtgatcatccgcttttccggaattatccgtggcggcatccgctgcggtcacattcccatattcatcaactgccgcaagtgacgggtcactactcttccaagtaattgaatccgttgcttcctctggcgtcagtgctgcatgtaccatggtcgtttgtgcattattgagccacgcgtcatcactcgtcactttgatgccagtcgttaccacccgggctggcgtgaccgtcactttcgcgattttggaccaataatcaggaaacgccccaacaccagagaaatcatactggacttgaaaataaagatgcgttgttttggtcacttgcggcgcattgaaagtataggttcgactattagtgccaatcttctgataggtttgcccctcatccgtcgattcccaccaaacgtacttgcgaccactcaacagacttgtcgccgcctcaagcgcactgcgctgggcccgaaccgacagcgttactgagttgccaccaatcacatttgaatcgattggctgttgtgaaaaaccgcccgatagattcaagcctaagacggaactcggtggactgcttggcgattggggcgccgttttggctgctaaggcactcgtgacgatacctaaaccaaccagcatacttatcaccattaggccacaagccttgatcaactttctcatcgttcctcactccttacgcgaacgccgctggccaaaccagtacgccgccattagaagtgctaagagaatgactagtgccactgcaccccacagccaccagttgacctgacgcggtccaaccagatgatgattatgttgttgcgtccgttctgcagtcaaggtaaagtcacgggtgaaatcccagacacgctggccgctcgttagatgcaattttagttggtacttccctgcggctaagttttgcgtgcccaacgcgacttgatagttaaaccagctattcggtgccattgatcctgatttaagttgctgcgtggcaacggtttttcccgtcgtgcgttgaataacgcgtgcttgaattttgagttgtccaaaaagtgtcggcgtcagattacggagtttggcaaagagtactggttgcccattggtgggcgtcactttgacttcatcgaggactaacttaactggaatcgtcacttgcggctgacaccaaagcgccaccgctgtaacctctgcatagcgattcttcaacataaaaccttgactcgtcgttggccgggccgcattggcggttggattggtgacaaagaggccacctaacacctccccttggaacccagacttgggaatcgtggtcttaaaagccaccgttttcgcttgatgagccgctaacttaactacgacgccacttgacgtcatgtcagtaaacgtcgtcgtggcagatgggtcatgccgcttagacggcacgtacgcgacgctgcctgcatctgaggtcgttgcgttgaccggtgttacctgcaacgtaattgctgatttaccaggattgctgacggagactctgaacgttgacgtcgttcccggcgtgaccttcatattaaagtaacccgcctgcttatctagttgatccttgggcagtaggggtgtcagaataaaacccgatgcgggtgtgttagatgccgcttgaccaggtaatgaccctaaaagcccgcctagtagcaatgccaacactaataaccaccactgaccgatttgtttccatcgcattctaaacacccccacttcacttaatcattgaataacgacgcgcgatgatcagctgaacctatgaagctgcttttggtgttgctgcagcagctgctggtgcattttgaagcgtccagtaaagcgttgctgtgtaagttccagcagaaatattggactgcttaccgacttgcaatgaactgctcgtggcagtcgtcgctgtatttgaaccttcaccactatctgcagcagcattccataacgtttgtgggctcgcgacccatccgtttgtcacttcgctctgattcaaactcaatgcggtcggcgcggcagtattagcattgtcagcgttacccttggtcatattcaaattcaatgtggccgagtcaactttagccgctcccgaactaaacggtcccatcccaactgtcaacgtccagccagcatgatttccccgaaagtcgctaacgtttaaattgccactaccattgccatcatagccactgcctcccgacgtattgctacttgttgcatttaacgttgtggcagcagatgcaatattcttaacgttggtcgaacttaacgcgatatttggcacagcatccaacgttaattcaccgggcataaccgtaaattgtgcattcgataacgcttccgcattacccgtgctatccgcaacataaccagacgaaactgtcgtcaaattgttgcttgctgttccgggtccggccgctaacgccgctaggggcattagcgcaagtgatagtaaagttgcgccaccactcaacccggtcattaatttaaaagttcgcatgttgcttcctccttctcaatcgactgcttttccagtcgcctgctaccatattagtttactaatcactttatgattccgctttcaccgtcctcttcccctgacgccaaccatagtttatcatgtataccaatcgaaactgtgggttatgttttgattcattaactttccatattaattaaacgcctggtgataaccggccacaacgtggatacccagtcacccttgtaaccaaaaaaacatcaaggcccgttgtccttgatgtttttacatcattaattcatttatttttttaacgcttcatctaacgcaataacgcccttaactggaccaaccacagtaatcacatcatggagggccatcatatccgtcggcttgggcgagacatcaatgtgtttctcgtgtttgattgcaattaccgtcagaccaaaacgttgccggatctttaaatcgatcagattctgattaacaaagttcggatccgtaatctcgattgcggccaacgtatactcatcacttaagtcaataaagtttaaaatatggttggaaaggatgcggtgggcaatgccctgacccatatcacgttccggaaatacgacttggtcagcgccgacccgttcaaggacccgcccctggtcgctagtttcggccttggcgatgacctttttcgccccctgctccttgctcaacatcgtcgtcagaatactggcttccatattattgccaatcccaataatcacataatcaaacgtatcgacgttcaaatcacgcaacacctgctcgtcacgggtatcagcaatcattgtctgtgtcgccacgtccattagctcgttaactggttcttcgttaatatcaacggccaaaacatcctgatgagctgcggcaagagcccgaacaacactctcaccaaaccgtcctagaccaaatacagcaaaactttttcgcatgttgcccacctaaccaatcaaaatattttctgccggataacggatcaagttcaccctagcttgacgtctggaaagcgcgtagagtgacgtgaagatccccacccggccaataaacattagcatcatgattacaatcttcccaatcaaagtcagattgggcgtcaatcccaaactgagtccgacggttccaaatgctgataacacttcaaacaaaacgtattccaacccgaagcccttcggaattttttcagtctgcgttaagatcagtgttgccactgtcagcacaatactagccaagaaaatcagcattagcgcccgattgatattctcctgactaaaacgacgatgactaaactcaacatcacggcgaccacgtagctgggcaatactttggaacatcaaaacgccaaacgttgtcgtcttgatcccacccgcagtcgatccaggcgtcccaccaacgaacatcagaatcataatgaccaataaactccccgcttgcaatccttgagtaggcattgtgattaaacccgctgtccggggggtaacacttaaaaacagcgtattgatcgttcggttgacccacgacattccggttggcaacagttccaagtcacgttcagtgatcaacaacaagacaaaaccgatgacaaataaactgaaagttgtgagtaaggtcagtttggaatttaaagtcagtcgcttacgcgtatggtacagcagcacgtcacgccaaactaaaaatccaaggccacccgcaataattaggatcatcgtgaccgtcaagacgtatggatcattacgaaagccttgcagactatcgccaaacacatcaaaaccggcattacaaaatgacataaccgcatggtatagtgacacatacaatccgtgacgccaaccaaatcgaggtacaaaatcaattgcgagcaacccaagaccgcctagctgaaagagcagtgacaaacccacgacatacttcataacgcttttagtatcactcaatcgttccaaattcagggaggccttgaccatcaactgcgtagagagaccgatctgacgacgcataatattaaagaggagtaccgcaaaggtcatgtagcccagcgcaccgacctccgaaagtaccagaatcaccaattgaccaaacgttgtccagtgcgcagcagtattgacgacggtcagcccagtaatacatgtcgctgatgccgacgtaaacaacacatcgatcaacgacgtgtgcacgtttgctggcgtcgcccatgggaggctcagtaagactgtcccaatcagaattaagataataaaaccggctaccattttcttagatagcgtatcaaaaaatttaaaatgtgctaattgtctcataatcattccatcccacaacagcttatcgattataaccaatcagtccgattgatcatactccatttagcttaatcaacctagtcaagaaaagcaagtccgacctaagctttgacgtacgccggccacggccgacccaatacatacaaaaaaaccgctaatcaagctcagcttgatcagcggtaaaccaattacgaactaaacatactgtaagacgcgctcatcattataagcagcgtcaatcataccggaacctaagcattcctcaccgttgtagaagacaacggcctgtccaggagtaatcgcccgaactggatcatcaaaagtcacggtaacttccgtgtggtcatcattaaaatgcaccgtcacaccagaatctttttgccggtaacggaactttgccgtcacgtggaagtcattacctaagtcttcatcagtcacaaagtgtaaatcggacgcctttaagtgggtcgcgtacaggtgcggattatggtagcccttgccaacatacagaatattcttcttcaaatctttgccgaccacgaaccatggctcgttatcctcgccatcaccaccgataccaagtccgcggcgctggccgatcgtgtaatacatcagcccggcgtgctcacccttcacctgaccatcgaaagtcatcatcttaccgggcgttgctggtaagtaatggcctaggaattccttgaagttcttttcgccaatgaagcagatcccaacggagtccttcttcttagctgttgccaagcccgcgtttaaagcaagcttacgaacgtcaggcttcaccatttcgccaagtgggaacatcaccttttgtaaggtcttcgaatccagctgacttaagaaataagtttggtccttgttgctgtcaacaccacgcaaaaggtgcatcgtgccatcttcatcatgttgtaaccgcgcgtaatgaccagtggcaatgtaatccgcccctaaatccatcgcgtaatctaaaaacgccttaaacttaatttctttgttgcagataacatcggggttcggtgtgcggcccttcttgtattcgtctaagaagtacgtgaagacccggtcccaatattccttctcgaagttaatcgagtaataaggaatcccaattttatctgccactttggcaacatctttataatcttcggtcgcggtacagacaccattttcgtccgtatcgtcccaattcttcataaacacgcccaccacgtcataaccttgctgcttcaagagcaacgccactacggatgaatcaacaccaccactcatgccgacaacgacacgcgtgttactgtgatcagtcatacttttcaccatcatttccaaaagattctggagaatccacgatttgaaggtcgtacaagtccagtaagttacattataacaaagaaaacgccggctgcaagccaggcgttccctgattagtccgtcgtgaggacatcccgttcaataaagttagctaaaatataccgtaattgttcaacagcttccggatgggcgtcatttttgaaaatatttgcccgttggacaccattgcccgttaccgtcgtcatcttaaacccagtcaaatccgcattgactgtcatcttcagcttgaaagccgcttgatagggtgaagtgggatccaaggaacgttcaaaactaaacgcgcccgagcgacctttcacaaaacccaaatccatcaacgtgtatttcttgaccgttggactcagcgtatacgtcttagtatccccatctagtttaaccgttgttgtgtatgccatcgtcacgccccctgctttttaataagcgctgcgtcgtcttcgtcagcaccgttacaaactgatccagatcggccttagtagtatagcgaccaaagctcaaccgaatcgactcgctgatccggggagagtcttcaccatacattgcaattaaaacgtgtgatagttctaggctccccgccgtacatgcggagcccccagaaactgcgacaccacctaagtccaggttagtttgcattgtataggtcgatacccctttgatccataagttcaaaacgtgttgcaagttatgctcaccgagggacccgttgacttcaaaatcaactccgttagccgttaactggtcaacgatgtattgcttgaactcacgatacttagcctgccggtgggctttctcagcggtcgtcagttcttgcacggccgtggcaaagcccgcgattgccgggatattttcagtaccggcacggcgcttatcttcctgttcgccacccttgacaaagctaggaaagttaatgccattgcgtctgtacaagaagcccaagaatttaggcccattgattttatgtgctgaggtggacaacatgtcaatatgatcccgttgcacatcaatatccaacaacccgtaggcctgcactgcatccgtatggaaccatgcctggtgatcctttaacaattcaccaatttcatggattggcatctgtgaaccaacttcattattcccggtcatgattgagacgagaatcgtatcaggacgtagtgccgccttcaaatcatccagactaatttgtccctgttcattcacgggtaaataagtaatctcaaacccatgttctgccaaaaaagcagtcgatttaagaatcgcttgatgttcgattgccgtcgtaataatatgcttgcctaaatgttggcgcgtccacgcggtctgcatcaccgccgtattatcactttctgtaccaccactggtaaagataatgtcatcgtcagctgcgttaatgctttgggcaatcacgtgccgactatcgtctaaaacttcacgggcggcccgaccgaatgcgtgggtgcttgaggcattaccaaacgtattcgtcatttgatccgtcatcgtctgaataacggacgctgccattggggtcgttgccgcattgtctaggtacacttgcttcattacatcatacttccttctaaataattcttagttattagcatcgctgcgatacatctgactaattttgcgccgcaaataatgcaagtaacatcgctgcggactgcttacccgcttccaggataaattcgtcaaaactaacaccggcattttcatcaccgacatcggacatcgcgcgaatcaccacatatggcgtctggaactggtgacaagcttgaccaattgcggcgccctccatttcactagatagtgcttctggaaagtgtgctaaaatcttatcggtagccgccttacctgcgataaattggtcaccggaaacaatcagtccagtcttggcattcaaaccggttgccttggccgctgccatgatttgctttacccaattggcatccgtttcgtagtatagtggctgttgtggtaattgaccatattcgtagtcaaaggccgtcgcatcaacatcgtgataagcagttgccttagctacgacaacgtcaccgacatgcaaaccagcgccaatcccacctgcagaaccagagttgatgacaacgtccacatcaaagttagtaatcattaaagccgtagtcataccagcttgcactttaccaatgcctgattgcactaagacaacttcctgctgatcaattgtcccatcatagaacgtaatatccttaatattaacgatcttttcgtcttgcaaagcgtcccgtaacgttttaagttcttcttccatcgcacaaataattccaaatttcatgtgagcctagcgcctactttctatggtgttaaaaataaaattaaaaagacaataataatcccaacgactagtccagcaatcgcccaattcaatttgcgggctagccgtttcgtcttggcttcttcaacagcccggttgttctcagcagcatacgcttgtcgggatgcactgggttcagccgttggtgattcttgctcctgagtatcgtgaccagttggctggctacgttgttgtcgatattgctgtctggtgagtcgatcatcatctgccactatgcttcaactcctaactcagggtgactttgccagtaccaaatcgccattacggttttggcatcctgaatctgaccagtctgaacttgactgacagccgtcgcgaggtccagcttgatgagcctaatttgttcgtcagggtcttgtgggaatgccgttgcaaccgcactcagaccggtagcaacgtacaacttcattagttcgtccgtaaacccgggtgacgtgtagaattgggcgactgcttctaagtgctgagctgtcaatcgggtttcctcatttaattcgcggacggccgcctggtccatggtctcaccggattcgaccttaccagctggaatctcgacggtcagcccaccggttgcagcgcgccactgttgttcaacaatcattttatgttgcgcggtaatcatcagcatcgcgacggccggctggtgtcgcacaatttcacgtgttgccgtcgtttgatctggtaaagtgacttcttgtcgttcgacctgtaccaacccgccttgataaaccaactgacgactctgaacccgttcctcaaatgtcattgatcaagaacccctttcagtgtctgctctctcaataaggataccgattttttagctcgattgcaattttcaactgggcgatttcggtaattttaacgaacccgcaaaaaatgggctaacgagcgaccaatttggctccttaacccatttttccaattcttaaaatcaagcggaccaattgacactaatcgccattaggcctttgcaaggttagcgacgaaatcttcataagcaacctgctcaccagtttccgttgcggtagctgggctgtagtcgccctgaagcgcatcttctaatggcaaagtcacgatccggacgaacgtcgcgttaccgatcaattccatccagtattcttcatcggcaccttggtgaacaacggttttgaccatcccaccaggattggtgacgtggatttcttgattaaaatcggtactttcttggtgtaataacacgtacatcaatgaggaagccgacatcgcagtcccacaagcattggtaaaaccaaccccgcgttcaaacgtgcgtacaaaaattgaatttggtcctaagacttccacaaaactaacgttgacgccatcagggaaaatttggtttttaccatcattcatccattcaccgatacgtcctaattcggggccaaccaacgtatcatggtcaacgaacgcaatcaaatgcggattaggcaccgccacagctgagaatttcaagtcagcagacagcgctggaatcttttcattaataattgtcgtcgcatcgttattcgcatgcatgccaagtgtctgcgcgtcgaaagttacgggtgaaatttcaacactgtaagctgggacgtgggccgcaaaatcagcaacggcctgcacctttaagtccgcatacatcgtctgaacccggaagtcttcctgactattttgcgtgcccaaataacgagcaacggtccgtagcccattaccgcacatgctagcttccgtcccgtccgcattaatgacccgcatccgaccaagtacttgtggatgttctgatttatcaacaaccaacacgccatcagcgccatcgtacaaacctgcgccgtcacgtttacaaatgttaattgccaattgcttcaaatccgcatccgataacggtgcttgaaattgtgtttgatccaataaataaaaatcgttaccagaaccgtgtaccttgatcattttcacagccatcaacatcctatctatataaaatcgaccttaatttaaactacttcattatcatactgactttttcatgaaaattcaattgcaaaggaccatttctcataataaccattcaaagtcctgcgcagcaactgtaaattcttaatagctcttaaatcttgcatctgaaaaacgcaatcagttttttacagctgtatctcaatcatcccggtgttcggatttactgactacttgataatccccacacgccagcacaaaaaagtgccactaatcagtcccgttcgactgattagtggcacttttcataagttatcaagactcacgctaaatctaattcagattaagcttccaaaccagttgttactgattcagggtagttttcacgaacgattgcggcgcaccgtgcacataacatcggataagcctcgtcactgccaacatcggtcttaaccattcggcaacgatcacaaacgtcaccgtcagcatggccaaccttgatggctaacgtgtcaccaaatgtttctgcgtctgcaggcgcgtcacttaacgcgtgtagatctaatgctgaaaccatcaacatctgccgaacattggtgctcaaatgatctaagaaggcttgcgtatcatcatcaacatacaaatccaagtgtgcttccaaggatttaccaatcaacttagcatcccgggcttcttccaacgcctttaagacgttactccgaagatccatgaaccgcgtccattgagccatcaactcgtcgctgttcgcataattttgaacagctggcatctcagctaattgcgcaaattcttctggttccttcaagaatggccaaatttcttcagtcgtgtgtggcagcattggtgtgaagagcttcgtcaaggcaaccaaaacatcgtagaagaccgtttgcatcgaccgccgtgaatggctatcctcggcatcaatgtacataatatccttggcaatatcgagatagaagtttgataaatcaaccgtcaagaagttgatcaacttcttgtagatatccaagaaatcataatgatcgtaatgatccttcgtctcagctacgaattcgttcaaccgtgtttccatgtactggtccacacttgctaaatcttcataagccacgcggttggtcttcggatcaaagtctgcggtgttgcctaacatgaagcgtaccgtattccggaacttcttgtaggaatcggctacttgcttaaagctttccattgagacccgaacgtcggaactggtatccactgaagcgacccacatccgaacgatttcagcacccatctgcttaataacatcagctggcgcaatcgtgttgcccagtgacttactcatcttacgaccttgattatccaacgtgaaaccttgtgacaagacttgcttgtatggggcatgtccagaaacagccacactcgtaatcaagcttgagttgaaccaaccacgatattggtcagaaccttcaaggtataagtcggctggatagtcgaggtatgagcgctctgccaggacaccttggtgtgatgaaccagagtcgaaccaaacatccataatatcggtttccttagtaaaggtaccgtttggtgaatgttcattggtataaccatctggcaataggtcctttgcgtcgcgttcgaaccaaacattcgaaccatacttgccaaataaatcagctacgtggttaatcgtcacttcgtccatgatggcagtgccatcttcagcatagaagattggaagaggtacaccccaaactcgttgccgtgaaatgacccagtcaccacgatcacgaatcatgttgtaaagacgctttttaccccactctgggaagaattcaacgtcatccatcgacttaaggatttcatcacgcatatcaccaacggaagcaaaccactgtggcgttgcccggaagataatcggcttcttagtccgccagtcaaatggatagctgtgttcgtatggcatatatttcagtaataacccagcggccttcaacttgtccagtgcgatcttgttagcgtcatcgtagaagacccccgcaaaatcatcaccagcttcagccgttaagaaccctttgtcatctacgggagcaaagattggcaggtcgtattgcttaccgatccggtagtcatcttccccataaccaggcgcagtatgcactagcccagtcccagaatcaagtgtgacaaaatcacctaacatcgttactagatgccgactattgtcaaaaggatgttcgcacaaaatgttttcgagttccgcacccttgaccgttttaagcacttgaacatcttcccaaccaaatcgttcggcattttcgtccaacaattcagccgcgagcacaaacttacgattttcaccagccggttgcacaacgacgtaatcaaaacttgcatcgattgtgattccttctgaagctggaatcgtccaaggagttgttgtccaaacaaccatataggtatcatcatctaagacacccttaccatcaatgacatgttcaccgtagaaggcggatggcgatgtcacatcatgatattccacttcagcttctgccaaagccgattcagaagaccatgaccagaagacaggcttttggccccggtagatcaagtgacgtttagcaaacgcaccaaagacccgcacttgagccgcttcaaattctggctttaacgttaagtatgggttgtcccattcaccagcaacgcctaagcgcttaaactcatcacgttgacgatcaacttgttccaacgcgtatttccgacaaagttctcggaattcattgtccgtcatcttcttgcggtcataaccggcttgctttaacttctgttcgattggtagcccatgggtatcccaaccaggaacgtaaggtgcccgaaacccattcatcgacttatagcgaacgatgaaatccttcgtgatcttatttaaggcgtgccccatatggatatcaccattcgcgtatggtgggccatcgtgtaagataaagcttggcttaccttcattcaatttttgccgttgttcgtagactttattttcagcccacacattttgccgttcaacttctttgaccggtaagtttccacgcattttaaacttggtcttaccgaggtttaacgtttctttaacgcgcatattctcactccttaaaatttttatcaaacaatcgccattggatttttagacacaaaaaaacttcgtccacccagggacgaagttatcgtggtaccacccaattttagaattgtttaaattctctcttagcatggttaacgtccatggaccggccacccttactcaattcaggatagcattcggagatgatctgcaactaactaagggacgactgcctttccattgccggcagctctctgggcgtattagttaattgtttgctgttctcctcaatacattcaattcgcttcaattgtgcctgacgatcgcctaattaattattagtgctgtcatcatcagggaaaataaccaccgtctgttgttggacttgatcgccaccgtccgcaacgggggtctcaccactcgttgcttccgtaatttcaacggttgcttctgagtttacgctcgcatcccccgagttgtcaaggttatcttcctttaaaacgtgttgaatttcagcataatcagccgtattcgtttcgctaagtagttgatcccaatccttgctcttaaccacttctaactgcgattctaacatcacttgcaagcgttgccggaagacccgcgtttgtttcttcaaatcatcagtttcaacggataatcgtttggccttttgagaagcttcgtcgatcatttggtttgacttgtcggttgcttcactcacaatgtcagacgcttgtttctgagcttcgcgggtgataatgtcggcttccttcttagagttcgtcttcactttatcagcagcttcttgagccaccaagatagattgattcaaggaatctttcaattcattgaaatacttcaacttaccttcactcgagtccaaccgttcttggaggtctttattttgcttcaaggtaatttgataatctttgataatttgttctagaaaatcattaacctcatcaatattgtaaccacgcagtttcgttgaaaactctttgttatgaatgtcatcaggacttaacaccattagaattcctccaatatctatttactatgaataatatttaatgttattcgcagccgcgcttttttggtctcaccgctaatttcggcaagtcggacacgaccgtaatggttcacactcagcatatctaacaatgctaactcgtaatcagctttcggtaagtcagcccaattcagccgaaccttagcaccttcgatcaattccttggcgtgatgccgcgacaagttgaacgccgccttaatgatactatccgcacgtaatgaactaaccgtcgtagtaactgcctcccagtcgtcttccggtgtgatcaccgccgacaatggtaccgctgttaagtggactttcgtcttaccaaaacggtcgatttgctcctcgaaatagctggccatctcggtttcgcacacaaactgccatgtcgttccgtcagtcacgatgtcaccaaagacatcacgctcgacgccggcattggcaagcgtacccagaatttgaccatgctttaaggtggcaaacttcacgggataaacaatgttaaacagtgtgatttgaaaatcggccacttcaggttcgtaatacaccgggtaaaataagatccgttgtaactcagcaccttcaaagccaccggatgcccgcatccgcacgtcgtctaactggttgaccagcgtttgcgcaatgtagatttgtcgcgggttcaaaaacgcagttaagattggtcggtactgatcagctacttgccgtagccaaccagtgacctgttcaataaatggggcttcactatcgcgaaaatgttgttttaagttatcattcacgatactatcctcgttattttaatttagtatatcaataaagttatcagataaaataggccactttcagctaattggagcactaacagcgcaatgatcggcgaaaaatccagtccggcaattgcgggaataaagcgccgaaaaatactgagaaatggttcacagatttgacctaagaattggcccacgcgagtattataagctcccgggaaccatgacatcaaaatgtaaaccacaatggctaattggtacagttgaaacaaccgactaataatcgtcactaacaggccactcactccttataatttgctcgtatcaaactgacttgtcgtacttccggaaacctcgtaattttcaggaatacagaggaaaatttcatcaccaatccgttcgatctcaccattgatggcaaaaaccgtcccggtcaaaaaatccacaatccggcgtgccatttcatcatcgacgtgatcaaaattaatgattacagcttgatttttcaataactgcgtcgcaatttctttcacgtccgaataaattttcggttcgaatagggcaattttgctattcaccgacttgcccccttgcattggaactacctttggcgtgctccgagtattggttgcagattcagtgggagccgccgcttgggaagcttcggtgggttcctcatactgactgtcagaatcaccaacaccaaaaaagttactaatgaatccggccatgtgcttgcgctcccttcaccgttttacttacgccggcgcttgaagaatggtggtgtatctagcgaatcaccactgttatcatccttactatcgtcagcttgtgagttgtcattaaagacatcaaaatcagttttttcaacattgttaaactcttgaccattgttgactggccgtgaattgttcggttcgcgccgaatatcccaattaccgaatgggtcgttagcttgggactcacttgattgggccgcttcactcgtcgctggctggtcagttggcgttgcgaacatgccgcctcgttgctgactagcttcactacgactaggctggctgtccatcttgagttcgcgttgcttctgatcgataccagtggcaatcacggtcacccggacttcatcaccaagactttcatcgatcgaagtcccaaagataatgttaacatcagtcgttgccgcttgggaaacaatgtcagaagcagcttgggcttcatacaaggacatgtcggggccacccgtgatgttcagcaagacttgttcggcaccatcgattgaaacttccaataatggtgaagaaatggcttgtttagtcgcgtccgccgtccggttttcaccactagcagagccaatacccatcagagcggaaccttggttttgcatgaccgtcttaacgtcggcaaagtccaagttaacgtaccctggtgacgtgattaagtcagagataccttgaaccccttgacgtaacacattatcagcttcttggaaggcttccatcattggagtcttcttatcaacgatttcaagcaaacggttgttagcaataatgatcaacgtatcaacgttgtctttcatctgagcaattccttcagcagcgttacgagcacgcttaggaccttcaaatgtaaatggacgggtgacaacacccactgtcagcgcgccggagtccttagcaattttagccacaactggtgccgcaccattaccagtaccgccacccataccggccgttacaaagaccatatctgagccttgtaacgcttctgtcaaggcctcttcactttcctgcgcagccttggaaccaacatcaggattagaacctgcgcctaatccccgcgtaagctttggtccaagttgaattttagtttcggcatttgaagtttgtaatgcctgcacatcagtgttggcaacgatgaattcgacgcctttaacatcttcagcaatcatccggttaacggcgttaccaccaccgccaccgacaccgatgactttaatattagcccctgagttctgggttgaatctaaagaaaattccatgttttttcctccgtcatttctatccgatattaatcaaagaagtggttgaagaagcctttgacccgttcaacagttcccttatgatctggatcagcctgttcctgtggtgcttgtggcgcagactgtttcttagttgcttttttaggttgtgctgcgggttggctaggtgctggtgttgtattagcaaattccaacgccacactggcacgagtatcaccggtaagtgcactcttaacgagtaacgtaacttcactcaaggccgcttgatatttgatgaccgctaacgcctcatcaaacgacggatgcctcaagcccatttgattaggcgtaaagacgcgaactcgcgttccaaaacgttgcgccgccaaatcagtgataccgggtaatgctgccaccccaccagttaaaacaatgcccccggggagctcgagcgcccgaatctcatccaagtgctgcttgaccttatcaaagatctggtctagacgagcctcaatgatttctgctaagtattgctcacttatttgctccggtgtactttgcccaacaacatcaactgggaaaagttcatcatccgaggcctgctgagcatcggcatagccataatcacgctttaacttctcggcattctcgatcgatgtattcaaaacgaccgagatatctttggtaatatactggccgccttcttggtcaacgtaagtatacttcaattggtgatcatgtataactgccgcagtcgtttgaccaccgcccatgtcaataatgatcgaaccaaaatcttgttcaccgtcattcagcactaaggaacttaatgccaagggcgcgatcacaatctgttcaatttgcagtccagccttttccaaagccttccgcgtattgtgaatgattgttttcggaccagtgaacagggtgccgtgcatttcaagccggaccccaaccatgccacgtgggtccttgatgccatcaaaaccatcgacgacaaattcatcggggatgacatccagtacttcccgctctggcggtaaactctgaactaacgcagccgccgcaacgttttgaacatcttcattattaatttctttggactcatctgccacggcaatcataccacgacagcgttcaattttaaccaggttagcgggaactcccgcaatcaccttttttatttcgatacttgctttttcttcagcttggcgtactgctgatcgaatcgtttcggccgccttatcaatatcgacgatcacgccacgacttaaaccattagaacgtgcgcttcccacaccaataacgttcatttgccctttaacacgttcagcaacaatgacttttattgaggtggtccctatatcaagtccgacataaattcctgaattatccataatagaggaacctcctagtattttacataaatattcaaggattcgctgacatatccagttattccttagtttaccatatcctaagcgcttttaaaaaggtcacacttagcattctatcaattattctgattcttgaacggataggagtatgcgcccacctcaagattgatgacacccttggttttcatcttcgccacaattcccggataataagccatcttgctagcaaaagtgctaattgttgcgtacacttcattaccgtcattcatgtaaagatgaacccgttcgggattagccttgttcggcgcaaacttgatctcagaaatattgtgtttgaccgccgatggtaacttagcgtactgtgcaatcatcgttgctaagcggtgaccgcttttaaagttggcatagatcggtgaaccgccaccgggttgagaataggtcgctttcaaaatcagcccattttccaaaattcgtcgatagtgttgaccagtcgataagtaacccgcgatgcgaatttccttaactgtcacccgaacactgttcaatccaactagcttagtcgtgaccttgccaatttgcggctgggcgcgttctgcgcgcttagtagtccgttgatcatgaccaatcacggaccataaggcaactccagggttgatcttagtcgccgtcttgacctgcgtaacagacaattgatcgttaccatgtacggtcaccgtctgaacatggctcagtggtgaaatgaagtaaccagccacaccagcaccgatcaggaaacagcccatcaagatcacgacccgtttgaaaagtaatcggcggcgctgagatttgagtttcggtaatttatcgccaattcgcaggcgtttacctgaccaactatggtgactcttttgcgctgcgcgatgattctcagccgcgtcccgttgaaatcgttcccagggtgtcagctgctcggggtgctcacgctctttgggctttttatgaaaaatggccatcacacccaccctttcactctagtctctgtgctacttaatcaccgtttctaaaacgtgtagtaactggtcggccgcatcaggcatccccagttttttcgcattagccgccatcgtctcacgatgcgtggtactttggagaaggccatctaatgcagctaccaaactggttcccgtcaaatcagcttccttaatcagttcagccgcccccgcattcacgaggctttgtgcattcttggtctgatgatcattcgtaacgtatggactaggaactagaattgaaggaatccctaaagccgtaatttccgcaatactagttgcacctgctcgaccaagaataaccgcgacttctggtagaattgctggcatatttttgatgtatggttcgattttaacattcggagctagcgctgtcgctgacaagccattccgaatcttttcgtagtgtacctgaccggtgacgaacaaggtctgatagtcacgtttgttcagttcaggaattgccgcgaccgctgctgcgttaatgcgcgcagcaccccggctccccccaaaaatcaacgccgttggaatatcaggatccagatcaaactgcgccaaagtgccactttttttaatattagccacttgttgggctcgaggattcccagtcatcacaactttttgagcgggaaattgtgatcgcgcactctcaaatgaaatggcgattttatccacaaaccgacttaggaatttgttagtgacaccaacaactgaattctgttcatgaatgaccgttggaatgtgcatctggctcgccgcgaaaacgaccgcaccactcacgtagcccccggttccgaccacaacatctggtttaaacgccttaatgtacttacgcgccgtaaccacactctttaaaaacaaatagactgttttaacattttgtaatgacaatgaacgcttaaagccctggatcttgattgttttaaaatcgatcccccgttccggcacaatgcggctctctagtccacgatgggttcccacaaactgaacttgcgcttcgggatcatgtgcttttaaggcatcgatcagtgccagtgcgggatagatatgaccacctgtcccaccgccagaaatcattaatcgcattagttttcttccgcctttccagttaactgttcgattgctttaataaatcggtcgccccgcacttcgaagttcgggtactgatcccaactggcacaagccggcgataacatgatgatgtcaccagcctgactatgttgccaagcaattggcacagcagtctcacagttgtccgtaaactcaatatcttgaataccagccaaacgcccagcgtccgccattttttcagcagtctcaccgaagacgattaacgtcttgacatgcgcctttaatgcgggagcaagcttttcaaacgtattaccacggtccaaaccaccagcaagtaaaatgaccggctgatcaaagcccttcaaggccatctcggtcgacaccaagttggttgctttggaatcgttgtaaaattgccggtcctgatacgtctcgacatattgagtccggtgtcgaacacccgtaaacgtcttcaagacttgaacgattcctgctgttggaacggcttgaagtttagcaacagcaatcgctgctaacgcattttcaacattatgatcaccaggaatccggatatcagcagcatccatgatgtactcatctttaaagtacagcttgccggcctcttcataggcgccatctttcgtattggcttgccgtgaaaatggcacgacggttgcttgtgattgcttactgagttgccgccattcttcactatcccaattaatgactagataatcattagccgtttggttcatggtgattcgcatctttgccttgacatagttctcacgtgagccatggtaatccaaatgcgtcgaataaatattcgtaatcaccgcaatatgtgggtgcaaagtttgaataccacacaacataaaactcgaaagctcagtcaccattgtgtcggccgccgtagccttttgtgcaattgctgaggccggcacgccaatattgcctgctacgtaagctttaccggcatttgtgcgttgattaagcatcatcgtgatcatcgtcgttgtcgtggttttaccgttcgtccccgtcacaccaatcaactctcccgctaggatttgcgatgcaagttcaacttcggtaataactggaatacccttttcctgagccccactcacaattggatttgagtatggaatacccgggttcttgacaacaactttaaaatcttcatctagtagtgacagcgggtgaccacccgtgataactttgattccatcactcaataattcctgtgcatccgggttctcatcaaatttctttttatcattaacggtcacaaacgcacctaatttgtggagcaaccgtgcggcattgaccccgctctttgctaatccaagaaccaaaaccttttggttacgatactgctcaaccgacttcataaaccaagatctccctataatgtttgtagatgatacctaaattaacttgttatgtggctgatgcaccaactcgtggtcatcagcaaattattcatggtgagccagtgaccaattccacgacataatctgcggcagacaacgcaaccatttaaagaacaatcgttgcgttgataggaatcagtactatttacttgtcacttacttggcgaccaccaatgaataaagtcataccgcaaagaccaattatgtacaactaactcggacaagaatgcccgagttagcaaactgtgactaaataatcgtggcaacactgattacggctgccactaaaccgatcgaccaaaaaacgatatcaatcttccactcgctccaacccttcatctcaaagtgatggtgaattggactcatcaggaagatccgttttcccgttaacttgaacgaggcgacttggaggataactgaagccgtttcaatgacaaaaatgatgccaatcaagaggagggatagttcatgatgcaataagatcgatactgcagctaaagcaccaccgagcgctaatgatcccatgtcacccataaagatcttggccggtttgtgattatacacgaagaaacctaatagtgaccccacgacggccaaacagaataacatcacattatactgattttgagcgtaagcaatcacggcatacgcaccaaaggcaatcgtggcctgaccagcgactaatccgtccaacccatccgttaagttgacggcatttgagaagcccactaaccagatgatggcgaagagcatgtaccaaattcccagcgaccagacccccaaacctggaatcctaagtgccattggcaaatgttcatgttgatagaccaacgttaaaattactgccccaatgacttgaccaagtaatttttgccaagcctttaaaccttcgttttgtttacgccaaagcttgatactatcatcccaaaaaccaagtgcaccgtataagaccaggataaacatcaaaatccaggtggttggttgtagctgatgttgccacccaccgacccataacgtggtgactaagattgcgataatgaacagtaggccccccatagttggcgtcccagattttttctcatgccacttaggaccttcctcacgaatcatctgtccttctttgcgggcgcggaaataccgaataagtgacggcattaacgcaaacacaataataaaaccactaattagggttgcaccccacactaataaactcacaacaattctccattctaagacttgataactacttcagtgtcacactaattgcctgcttagcttcgatcggattacccgcagtcacactttgcgtcttgacgtaacccgtcccgctagtcgtgagcttaacgcccgtcaacgtcgcaaaatcagccacttcacttgctgaccatccagataagttcggcatatacatctgcccgttggtaaccagaatgacgcgttgaccacttgaaacgacagtgccagaagaaatggattgcttgacgacccgactacccttaccaacaacgaccacgtcaagtccctgcttcttagcagctttcttggccgcgctagtcgacttactcgtcaaatctttcattttgatcgtcgtcgctttagtctcactcgctttttgttcttccaatgcccgtttcatcacggtatcaaaaatctctgccatgtcatctgacgcggaacttccgttaagtgtcggttgtttcatcgtaatgtacataatgtacttcggatttttagctggcgccatcccgacgaccgagtacagataggtgttgtcaccttgctcatacgtactcccgttgctgacctgggcagtcccagtcttagcagcaatgcgatacccgctgatcttatatgatgagccagtaccgtatgacttatataccacatcttgcatatgatccaacaccttgctggcagtcttcgaactgattggctggcttacaaccttcttcttacccgtataaaccgttttgttggtgttagggttagtgatcttggagataaagtacggctgtaacatcttaccatgattagcaatcgctgtgaatccacgaagcatctgcatagcggtcacctgaatcccctgaccaaaggccgtatccgcttgttcgattggatacgtaaattgaattgaaccactctgctcgttgtcaagaccactattagtactctcacgcaacccaaagcgtttaatgtacttcagccaagtcttggcccccattgcttgttctaggtgggccatcgccgtgttacttgaaagggcaaaccccttagcataggtaatattgccccacccgctcgtattccaatcaggaacggtattattaccgatcttatattcaccggttgggacggttacattagcattgtacttaccgctgtcgatcgccgctgccattgtaaagaccttcatcgtcgatcctggttcatacgtgtcttcaaccaacaaattacgccacattttagatagtccggtctttgtttgcgcattaaatgtcggtcgctgcgtcgtcgccagaatggcaccagtcttcgcgttcatcaacgttgctgtcattgacttaggtgagaccttagcgtttacttgtgaaactttagtttccagtaatgtctgtaacttactatcgatggtggtataaatattatccccatccttaaccttcttaccagtctcagtgctaccttgatatccgctcttcgtaatcgtcttgcgaccatcggttcccgataactgcttgttaaaagccaactcgatgcccatcgaccccgttaaccgcgtctgatcggtatccttctgactcttggaggtggtcagcccaaccaagtgggaagcaaacgtgccgtttgggtagagccgcgcttcagattcaataaagtgcagcccagccacattttgggcatcgatcttttccttagtcgtcagtgaaatattcttaccagccgtcccaaattcaatttggaacttacctgcgcctttttgcaaggtcgcgagggctttcttatagctgattggcaaatacttcgataagacacgcgccgccttcgcattatttttaacatacagtgccttgccactagcactttgctgatttttcgccataatggcgtagaccgtgtacgtgctagtatcttcagcgattgggtcaccgttggccgtataaatagtcccacgtttggccgtgatggtctggtcttccgtataaagtttcttggtggcctcgaccagattgaccccgttgacgtggcgcacaatcgcgatatatgaaaaacgaatgatcaaaacaccaaagacggcaatcgcgccaaaaaatagccattggccaaaaattctacgattttgttttggtgaccgtttcgaagtcattcgttgtttgttcttattcatttgtaaacattccttatgctaccgttgttcagcgataacccgtactgcttagcaattttatttaaacggctccgacttgaaagttcactgatttcttgtgcggccgacgtattttttgcctgcacttttgtgactttcgtttgcaccgtctgtaactgactttgtgcgttactcgttgcaatgttcgttgaaactaacataatggctaatccaaacaccaccaaactcaaaccaacacacaatactttttcaaataatgaaaaagcaactcgctgcgtcttgatggacggattcggggtcacaacggtttttgttttatgtaccggggtggttgcgccaggagtttgctgtggcaactcccgcgctaatccattttgggccattttaatcactcctttaattattcctgaatattatttattcgttatctttaaacgttcgatggctcgtaacttggcgctgcgagcacgacgattagcttcgatttccgcatcgctaggcacgaccggtttacgactgactaagcggtaatctggttgcatttcagctgggataactggtaaaccaggtggcagctccggcaaatcgctgtgctccttaaagatcgtcttgacgagacgatcttctaacgattggaatgtgatgacactgacacgaccatgaacattgattaaatcaatcgcttgttcgagcgaagtctccagtacgcccaattcgttattcaccgcaattcgaatagcctggaaaacccgtttagcgggatgaccacccgttcgccgcgctcttgctggaatggcattcttaataatttcgaccaattgccccgtcgtcacgatcggctgaaccgcccgttcacgctcaatcaaccgtgcgacttgtttagaaaacttctcctcaccatagcgatagaaaatacgaaccaagtccgcatagggccaagtattgacaactgtttgagcagttaatttctgactctgatccatccgcatatctaacggcgcatcatgttgatacgagaagccgcgggcagcatcatcaaattgtggcgacgaaacgccgagatcataaactaccccgtcaacgtggtcaaggccccgagcatctagttcagtcttcaagttggcaaagttacttttgatgaacgtgacctgaccacgttcaagataagtcgctaagttactttggttataatcgattgcggtttgatcctggtcaaagctatacaagtggccttccggacctaactgttgcaaaatttcacgagaatgaccaccgccacctaacgtacagtccacgtagatgccatccggccggacgtttaacgcggcgattgcttcatgcaaaagtaccgttgtgtgttcaaatgttgccacgcgtgcgcccccttcctaaattattattgttatttaaaaatcaatcaagttttctgcaagatcatcgaagttcgctgcggtctccgtctcaaactgttgccagtgttcggcaccccagatttcaaatcggtcagaaactccgacgatcacacattgcttttccaactttgcatattgtctcaaggttgcaggtatcatgacccgtccctgtttgtctaattcacattcagcagcagcagcatagaaaaaacggacaaacgctcgcgcatccttgcgagttagtggtaaatcatctaactgtgcttgaagcgttgcccaccgttcagcgggatagccaaaaatacaaccatccatcccacgagtaatgacaaacgaagtgcccaatagctcacgaaacttggcaggaatgattagtcgccctttcgcatctaaggcatgttcaaactctccgaaaaacatcttagacgccacggccaatcaacccctttcattaaacataattcaagtctaccacacccccccacttcctaccacatcgttttgttacttttccaaattgttaacaaaatatcaaaaaaagtcccacctaacgttagtttcgttaggtgggacttagtgggggacatttttacgatgttaaaaagaagtggctgccaagtgctaggatatagacgacgagtgtcaataattccgctccccgccaatagagcttaaaaaagcgccagtaaaggatttctccgcgttcaacagcttcaatcagtgttaaaccgatccccaaaatcattagggacaacacttcgtacggtgccagcgaactatccgttgcttgcagtgtcagaaagtgggtgaaaacaattaaaaatggcggccaaaaatccaacaatcttaatccatgtggccaaacgcggtgtgcaacccgtttagcacctaaaatgatcatcgagatggcggctaaaaataccagctgcccataccaagtggtccataaatctcgcatatgcgtacttgcctccccattagtgtcgggttaaattatagagattatcgttaaacttttcaatcatctgtgacagccctataataaacataaactattactggagggatgaccgttgttacaatactttaccactggtaaaaatggccttttgactacgccgaacgaccatcacgatcagccatactggatcaacgttgaacgcccgacctcaactgaaatcgaccaactggtcacacaatttgatcttcccaaagattacttaactgccatcctcgacgatgcggaggtttcacgagccgagcaattatcaaccacgcaatccagtcaaccaatcttaatcgtgatgcagtatcccaaactcacgacgagtaagctggggtaccttgaatttcaagtctatcccttcgccttgattttagtggatcaagtggtcatcaccgtcagtaattacccggctagttttattcaagactttgtgatggacccggcctcgtctaagctaagtctggataatcacgaagattttgtgctgactatcatgtggtacatcgagcacagttttgtgaccgcactcgaattgatcaaccaacggacaagcgccctggaaagccgtttgaatcaagctactcacaacgtggaactctttaccattatggcttaccaaaaatccttgattcgttttaaggccgcccttaatcagaacacacccacgcttgacgcggttgaaacttcgatcacccatttcaacgcacctaatcaccaatcactcaccgatgatattaagattgagacccagcaagcgagtgacatggctgaaacgaccaatcagattttgcagcaatatagtcaattagtgggttcagtaatttccaataatttgaatgatgtcatgaaatttctgacctcactcacgatggtgttgacgattccaacgattatcggtggaatctatggcatgaacgtcaaattacctggtgccggtctcgtccacgctttcacttggctgatgctaggaacgattattctttgcattattagtatcgaatatttacgaaaccatgactatttttaatttcaattgaaaaaaaactgattccacgttaaactatgaaagaattactcgtaaagtgtggtgcatacaaacataatgaagaaaaaatcaacttttcaaaaaattacgatggtcgttatctggttaatgatcatttctaccattgggtcattggtgcttaccgccttatctgggttaggtttactaaccttctaggttaaacaccttgcgaaccacgaatggttgcaatacttaccaagaaaaaagttacgcttgctcacaacaatgaagtgaacccacaagtttnnnnnnnnnncaatctcgggggttcacttcacaagcgtaactttttttattactggtggatcactcagccatggtcggcaagcctagccaccaacttctgagacaatgtgaattaaaaaaatcacgcatttgtctctgaaaaaggttccaaccgttagtcaaatctggctaacgattggaacctttactttaacgtcgattattcaatcgtatcggcagcgccaccatgtgaagtcatgccattcaaatgatgcccaccagtcttactggacgctaagcgtcattacccgacgcgggcgcttcgtcagccgatttttggcggtaaaccttacgtggcttactcccctccgaagggcccaccacgccgcgttcctccatttcgtcgacgatccgtgctgcccggttatacccgatacggaagcgtcgttggagcatcgagacactggcggactgttgatcagtcaccaattcaacggcttcggcataatactcatcctcaccgtcacgagggtccccactaccagcggcatccgtctcgtcatccttgaccagcatactatcgtcataatcagccgtctgttgggctttgataaagttgacaacttcttcaacatcatggtcagaaatataagcaccctgcacgcgcagtggcttattcatgcccattggctgatacagcatgtccccacgaccaagtagcttttcagcaccgttactatcaataattgtccgcgaatccgtcccacttgaaacggcaaatgccatccgtgacggtacattggctttaattaatccggtaataacatctaccgacggccgttgtgttgccaagatcatatgaataccggccgcccgggccatttgacccaagcgaataatggcatcctccacttcgctcgaagtgaccatcattaaatcggctaattcatcgacgaccaccacaatatatggtaagacgggccgtgactgcccatcagccgcattttgttgacggatatattggttgtacccctgcatgttacgctgcttggaatccgcgaacaattcatagcgtcgctccatctcggcaacgaccttatgcaacgcccgggccgccttcttcggttccgtgactacgggcgtcaacagatgtggaatcccattgtaaacccctaattcaacctttttagggtcaatcagcataaacttaacttgacttggtttcgtgttcatcagtagccccgtgatcatcacgttaatggcaaccgacttcccactcccagttgaaccagcaatcagtaggtgcggcattttagacaagtcggcaacgactaaattaccagaaacatcacggccgagcggtacggccaacggtttggtcgggtgcgctggttgggcctcaacgatatcccgaaatgacactgttgaaatctgtttatttggcacttcgattccaatcaatgatttaccgggaatgggcgcttcgattcgaagatccttcgctgccagcgccaacgctaagtcgtccgctaaattgacgaccttgctgaccttgaccccaacagctggatgtaactcatacttcgttacggatggccctaagctgacattcttcacttcaacttgaacaccgaaactcgccaacgtggttgttagcttctgcgagttactctcaatcgttgcgtactcagcactctgatccgtttttggaatcttcgtcaatagtgttgactctggcaactggtagtccgcatcatccatcacttcagtcccttggagttcttgttcatgatcaaccgtagcagctgaagttggggattttatgggcgaggcttcacgatcactagccaccgtgatattcaagtcggcaggcgagctcgtaactgcactggctgctgagtccggcgccgaagtcccgctcgttgtctcagcaggggctgctgactgtggtacggttgacgttggctgcttctcagtacttgccgcttgattggcgcgcacttgttggtgaacccgccaacgggcaatttgaacccggagcacgtgcgtcagccattcataaccggatcgcagttgctggcccaattgcatcaaggcctgacgcaacgcttgcatcgtcttatggaacggcaaatcaaaggtaatgtagatactggcaaccatcaggatcagtgcgatcaaaattgtcccgacattagccaatagtggataagtgacactatagccagcagcgccgactaatccgccaccaagattactggccatgccccccttggcaaaatcatttttgatcagattccacgtcaacgaccaaaaatcggtatggtgattcaattgattaaacatcgggatctctaatagcaataagtaactgaagaaaaacaagttaccaccgacccaccaccgccaagtcagtcgtggccaccgaccaaaaatcatcaaatatcccatgacgaggagtgttagcccggcaaaaatctggtaggcattcccagcaatggctcggaaaaactctgcgaataccatgcccactaaccccaccttcaataaggcgagaatcgtgaccaatagtccaatcaggccaatgacattccccgtcatctgccgcttagccgcaaccgtcggcttcttcttgcgcgtcgaggtccggcgcttttttgttgttgcttgtctacgcgccacgcttcgttcatcctttctcaattaatactgtcttcattataacaaactcaagttcccccgtccccatcaaaaaacgcaccctaacgtttagcgctagtgcacgttctgttggttacttcaacttatcattttcatagtggtgcgaccgttcaaggtttgggaattgttgttgccgcagggcttcataaatcacaatcgcagccgaattcgataaattcaaggctcgaatatgtgaatcatcttggggaatccgaatggccttttcgggatatttgcgcataaatggttctggtaaccccgtcgtttccttaccaaataagaaatagtgatccttacccgtatcactataatcaacatccgtatagtcatgttcagcaaacttagacactaagtacaactgatttaaatcaggaatactagctaaaaaatcttgcaagtcagcatgataagtaatatcgacactatcccagtagtccaagccagcccgttttaagtgcttatcatcaattttgaagcccaacggttcaatcagatgcaaggccgtatccgttccggcacacgtcctggcaatattaccagtattcgctggcattaacggttcaaataacgcaatgtgatttgtcaaaataatcgtcctcattcatattagtctctacgccatgttcattcatagcaatcctattaatcataccatgtctatggttcaacagcgaactttgaaactaaaaaacgctttgttcgcattcttaaccaatctttcctatactaatcaccgtacgcgccggagggcggaacaggacgcacactggctgacgaacaccaatctaaacctgacacgttgtcatcatgattcatgccggattaacacgtacaaggcagcattcgaatcattttataactcgaggaggaattatctatgaaaattatgattattggcgcaaccggaatggctggctcagccatcaccaaactagcacttgaacggaaccacaccgtcgtggccatcggacgttctgaagaaaagctagccgctctaccggctaacccaaatttgcagaccaaagctaaagacgctttcgatctcacactatctgagctacaggcggttgacgtggtcattgacgcaatggcgactagtcctgataaggcttaccgacacgtggatctggcaactaagctgattgctcagctccgcgaacaacagcggccacgtctcctcttcatcttaggggccggtagtttaacaactggtgatgatcaacacctcttcgtgcacgacattgaaagtaatcccgccaatgctgccttcgtcgctattccgcaaaaccaactggccgaactgaccttcttacgaaccgtcaccaacgtcgattgggttggaatttccccggccgccaatttcacagcaggtcctgctaccccggcccagtacggccatgacacattactgacgaacactactggtgaatcagtgaccaatagtggcacgatggcggtagccgttttaaacgaactggaaacgcccaaacatcatcaagaacgctttacagtcgctaaccagtaaacgtcttgcctagcagcgctaaaatatcgagtggcagccaaaccacaagccgagcgctacttgagcaatttagttaactgtgacgcgctttaaataagaccaattaatcccgccagaatctgacgggatttttgtggcgtcgcaattgctggcagtatttaacagctaagtgctgccaccgccccatctctcctcattgcgacagtcgtagccaacattgtcactaaccagttggttgcattacaccgccagttaacgccctcaccgacctttaattaattcttcaccaaagcatgctaaactattgccatgattatttgaaagtggggataccatgaataaccgtttatcaggacggaatttactcttcatcggcaccatgttatttggactatttttcggtgctggtaacttgatttttccaatttttctgggccagcaagccggccaacacgttggtgcggccattatcggactattgatcaccgggattggacttccattactaggcgtgatcggcatggggctgacgcgcagtcagggcgtatttgacctggcaacaaacgttagccgatcatacgcgtatgtcttcaccgtactgctttactttaccctcgggccactttttgcaatgccacgattagcaactacggcctttcagattggactggcccccttcttaaccaccaaattacaacccgtggtgctattgggcttctccgttgcttttttcgtcgtcacttggttactggctcgtaatcccggtaagattatgacctatgttggtaagtggctgacacccatctttttgctattattaggtgccttaatgcttgtcgctatcattaagccactgggatcacttaacgtcgcggcgagtggcgcctatgtcagccatccagttctaactggttttactgaaggctacaacacgatggatgcgttagcctcgctagcttttggcatcgtcgtgattgatgtgattcgcgacctcggtgtccgtgatccggggcaaatcgcaactgataccattaaagcaggcctaatcagcatgagtttaatggcagtcatctatggtctgctggcgattatgggtaccatgagcttaggtcgcttttctccagctgccaatggggggattaccttagctcaaattgccgatgcctactttggccgattcggtaatgttttactagctctaattgtcatcatcgcttgcttaaaaactgccattggcctcacttctgctttcggtgatacgttgcatggcatgtttcctaagatttcctaccattggctgatcaccatcgcttgtctcattccagccattcttgctaacgttgggctaactgaaatgattacttattcaaccccagtgctgatgtttctctacccgctcgcaatcgtgttaatcatactggcagtactggcaccatggcttgggatgtcccgctggttatatggaatgacaactgtctggaccatgattccggccattcttgccggcattaacgctatgccatccgcctgggtacaagcatcctggttgcaagctttgcttcatctcaacgcgtggctaccgcttgccaatctagggttaggctggagtgtacccgcactgctaggttttggtttagggtggttgatcagccgtaaacaaccatctgcttctaaattgcattaatatagcgtcacatataaaatagcggaccttctgatagccatccacgacttttcagaaggtccgctttaaattacgagagccatgccaattgactggttgccattgaacctcaccggtgaatcatggcattattcaggactggtatgaatgcaatagcaacacatggtcacacctcaccgtcagcttttgaagacacaaaaaaacgtagtatttcggtgtgggcacggcgaaacgctacgttaatgaagtacaactcggtagtcaccaacgacatgtcgatgttaactaccaaacgatttctcaaaggttatcttaacaccggcgtttcaatcatgcaagcacccgcgctaacctttttgcatcgttaataaactcacatcaacggtaatcttagttaacccctgccgtttagcggttgcgagctgctcagcatccgcaccccagtgcagcggtgtcatgactaataagtcgttaaagtcaatgttatcaagcgcaacttggtattgaattcgttgccgcttagcagtgggatagtgctgggcaaacagatctaacacccgttgattatcatactgatactgtcgatcagtcggtttaaatagtaaatgacgcagttcaactaagtactcaggatttggcacgatcttcaataactgtccaccgggcgcaaggacccgttcaaactcttggtaagcggatggtgagaagacatccataatggccgtgaatgccccatcggtaaagggtaattgggccaaatcggccacacaataataagcagtcgtcgtcaattgggtcgctaagttaaccccatccttactaatgtcaaaaccaatccccacgtcttcagaattggcatgcattgtcaacaaatcagctaggggggtgccttcaccgctaccaatatctaagattcgttgcgccgtttttggcaatgccgcattaatggcttggacaatggggccgaaaaaaccagcttgcaaaactcggcgccgcgctgccagcatgttagcatcgtactcgctagcgacttgatgcgttagaaaatacaacgtccctttttttgaaaaatctacttgatgcccattaggacaacataagctgtggccgtcaattgtcacgtatgcttgattacaaactaagcatcgaaagcgatcgatatttgcctgaacaaactggatgccgcggtcaatttttttcacaggtgtcaccttaccttggttaattttatcattaggcgtcccatatccaagcgatgctttccagcttacctgaaactatggattcacgatgacaacatcgtgtaaaggacgtatgttcaatcataccatatcggggcggacaaaatagtagctgttacgatttaggtgtggtatcttattaactgttctaaaggctgacttaaattgtcaaaatgaatttgctaccgaatggcatgaatttaatgacataaaggagactcattcagatggcaaagaaatcaaaaattgcgaaagaaaaacgcatcgaagcaaccgtggctaagtatgccgaacgacgccaagcacttaaagctgctggcaactataccgaattggcaaaattaccacgtaatgcttcacccgtgcgtattcatcggcgcgactcacttgacggtcgaccacatgcttacctacgtaagttcggcatgtcgcgccttaactttcgtcgcttagcgcacgctggtcaaattccaggtgttaaaaaagcaagctggtaaagtgacaactggcgtgatattcactaatgattagtaacatcaccattcagttaaattaaaaaggttccacagaattgtcatcagacttctgtggaacctttttaatttggcgttattggtttaatcgcgtttcagcgccatctgagtagccaacaattaccttacttgttagtttgatcagttgatggggttgcttcagcctcatacaatcccgaagaccgtcgataccagtcaaacagatgtgtccacaaaactttcaagatcgcatagcctggaatcccgaaaataacccccatcaacccgaagattttaccagccgctaataggacgactaaaatcgtaatcggatgaatagctaagctactccctaagactaacggtgagataaagcggccttcaatcgtttgttcaatgacgaagacaatcagaacttggaccaacatccatggtgaggtgactaacgcaatgaccactgaaggcaccattgcgagaaaagaccctaaatatggaatcaaatttaagattccagccgcaattcccaacgtcagcgcaaatttcaagccaataatactgtaaccaaccgcaaacatcacggcaacaaagaacgccacggtcaattgaccacgaatataattactgacctgtgaattgatttctgtcaaaacttctaagaatcctgagcgcgctttggtaggtacaaacttagccatatacttcggtagttgatgaccatcgcgcaataggtaaaaaagaataaacggcattgttatcaacccaatgatgacggtcgttacggtactaaatacgcctgtaagtgaagtcaccgtcccggtcaaatacttcgaaaagcggccactcactagcttactgagatccgtgttccaactttcaagttggtcacggatactactgagttgcggatcattgagccagcgattaacttcagtactggcatttttccaataattgggccagtcattgataattgataaagtttgatcgcgaatcgttgggataatcgcaataatgcctaacgccaacagcgcgacaaccacaataaacaaaccaatgatcgtccaggttcgtcgtacgcgaaaacgcttttctagccagtcaacaagtggattaagcaagtagtacagcacaccggccaaaataatcggcaaacccacgatgctaaaaaattgccggaccggatctaatagccaatcgacttgcttgcccataaagaagatcgtcaatactaataaaataacgaccaaaatccgaatgagccgttgcgctgaccaccgttgtttctgtgaatcaggtttcaaacaatccctccttcctaagcctgatacgtaataacgctaccgaccttgattgttggtaactggtttggtgtcaaataaatgccgttttccattggtttggcaggtactggtttgaagtacaacgtcgcgtgcccaattgacgttaaattagcttccactagtccccctgcaaaggccaccgtataagtttgtcgatcgatcgtaatggtgctaccagcaactaacgacagactcgcgatgggctgctcaaatttctgaatcaccgcgatttgctgtaatggtgccgtggccgtttcatcgaataaaactaaaattggttccttggaatcgatagcattcgcaccaatcgattgtactgttgcagttattgtcatattgagacccccatcggttaattaattgctttaattgtagcatagtcctaatcacagacgccaatttgtcatcgcttacacgggccatatctatgctatacttgaattatctatcaaggaggtttgttatcatgcaagaacgcattttattcggaacatatacgaaaaaaacaagccaagggatttaccaaggaacccttgacaccactgccaaaaccttaaccaacgatggcttactggcagccactcaaaatcccacctatttggccctctcagctaaggattgcctatacagtgtcgataaggaagatgacgagggcggtatcgctgcttggcaaatcgacgggcaaactgctcacaaactaaacaccgttgtcgcacctggcaccccaccagcttacgttgctgtcgatgaggcccggcaactcgtctacagtgccaactatcataagggaacggccgaagtcatgaaaattgctgctgatggcgcgctgactttgaccgatactgttcaacatagtggccatggccctcgtcctgaacaagacggctcccatattcattacaccgacctcacgccagataatcgcttagccgtaatcgatttaggtagcgataaggtctatgtctataacgtcagcgacgccggtcagttaagtgaacaatccctgctcactatggaagctggctttggaccacgtcacctcgtgttcagtccagacggccaatacgccttcttagctggtgaattatcgagtcagattgcgagcttaaaatatgacgcccaaactggtgcctttacgcagcttggcattgtgaagaccattcctgccgactacacggcgcacaacggtgccgcagccatccgcttaagtcacgacggtcattttctctacgtctccaatcgtggctacaatacgttagctgtctttgcagtaaccgccgacggtcatttgaccctgattcagcaaatcagtacggaaggtgacttcccccgtgattttgatttagatccaactgaagcctttgtcgtggtcgttaatcaaaacactgataatgccactttgtatgcacgcgacttaacgagtggtaaactaagtctattacaaaaggacgttactgtgcctgaaggcgtttgcgtccgtttctagtaaaggatgaaactcatgttattaaaagaagtctgtgttgaaaattacactaacattcccgcagccattgcggccggtgccaatcggatcgaactcaacgataacctatccgttggcggtacaacggtcagtcgtggtgtaatgtctgaggcagccaagtataccagtgaacatcacgtgcccctagtgaccatgattcgcccccgtggtggcaatttcgtttataatgatacggaattaaaaatcatggaagcggacctgctacaggctcaatcattaggtgttgatggtgtcgcatttggtgctttgactgcggataatcagcttgacgaagaagccttagcgttattaattggtgcagccggtggcatgtcgatcaccttccacatggcttttgacgccatccctgaaaatcaacaagccgcggcaattgactggttagtagaccatgacgtcgatcgcattttgacacatggcggcccacttgatcagccgattgctgactgtgtcccccacttgcaaacgacgatcaaacaggccgctggccgaattcagatcctacctggtggtggcattaccaccgccaatgtcgccgacatcaccacaacactcggcgtcaaacaggcccatgggaccaagattattaattactaagaactgccaaaaaggcgcatctcattttttgagatgcgccttttgattggcgaagtaaactaaaaaattagaccattaatcacggttattcaatggtctaatattggcacaagcgcccgcactaagccaacttgccctgagccctcttccgcgaacaaattggtcattgtcaacgctgatcaattggctcgtgttcatcatcaatcatgctaattaggataaacataaaacagaccaaatcttaatggtcactttatgaattggcacgttgattatgaataattaaacggttaagatcagccggtaatggtgcaaaggtcgtgagggtctggctaatgaatggatcatcaaattccagttgcatgcagtgcagtgcttggcgctgaatccacgggtcacgaggaccgccataaagggcatcaccgatcaatggatgaccgctagctgcaaagtgcacccgaatctgatgcgttcggccggtatgcagccgtacccggacgactgtcatgttacgcagccgcttaaccacccagtactcggttaaagacggcttaccgtcgggacgggtcgttcgtttgataaatgaatcagcggcacgaccaatgggcgcatctagccacccgtggtcagtcgtcaattcaccactgacgacggctaagtacattttgcgcatcgcatgggccttcaattgatgatcaataatcgaatgggcaaaatggtgcttagcgaagagaacgataccgctcgtatcccgatccaaacgcgtggtgatatgcacaacctcattatcataatgggccgcttgataataaccttttacccgattcgctaaggtattgtcaggtaaggcatgcgccggtactgaggccactcctgctggtttattcacaatcaggtagtcacgatcctcatataagatatcgatcggcaacgtcgagacgcctaagtggtcattaccaatttcagcaggtgtgaccatcgtcacagtctcaccgcctgtcagcatatgaatcgctaataccggtcgttcatcaacgagaattgccccaccatgaaacttaacttttttcaacaaactacgtgtcacaccatgttgtgccaagagtgtcttaactttcatcgggttcgtctcatggttgatccaagtaaacctcattgctcgtccaacccgatgaaggatgtcccgacccgttgccagaagcgattatgacgatgctgagcaaatgcaattcgacgattagcaattgaataacgaatttgttcaattggccgcggctgcgtatccatttgatcagctgtaaagacaaagtgtgactgctgttgtggccgaatcgttattgtttcatacggcgctacgatgactggcgagcctaatgttcggaagactcggttgttgatcgacgcaatctcggccatttgtaaagcgtccaagcgcggatgaatgacagcaccaccaactgacttattataagccgtcgaaccagttggagtggagacgcataacccatcgccacgaaaacgttcaaatagttcatcttgaatataaacatcggcaaccatggtactcccaagcttcttaagcgttgactcgttcaacgccaaataatgatcagtcgcatccgtatccgcataagtaatatctacagctagcaagggataggtcacactctggccgttgtcttccagtaaaccgttgatcagttggtcgatttcataatctcgccagtccgtatagaagcctaaatggccagtatgcacgccaacaaagcgaacttggtcaaccatgtgactatagtggtgaaacgccgctaaaagcgtcccatctcctcctaccgacaaaacaatgtctgggtgctcatcatcaatttcaaacccggcagccagcagtttagtatgtaactcacccgctactttcttggtcttggcactcgcatttgcaaaaatcgttactttcatgaattttgatcttcctttgtcgtgtcaggctcatcgttgcccggccccttcccatacgagaacaagctctgagcttcttgaatttcctcacgaatttctgacatttctttatccaaactaaaggcggcttccgcagcccgttgtaatcgttgactcaagttttcagggaaatccccttgatatttatagttaagcgaatgttcaatggtcgcccagaaattcatggcaagtgtccggacttggatttcggccaaaattttcttttcaccaccgaccatttggaccggatattcaatcacgatatgatacgaacggtaaccagatggcttttcattactaatgtaatcgcgttcttccagaattgtcatatccgtccgttttcgcaataaatcaacgacctgatagatatcctcaacgaattgacacataatccgcaaaccagcaatatcctgcatatcttgttctaggcgatcttcttgtactttacgtcgggtcatcttttccttaatgctatcaacgggtttgacccgccccgttacaaattcaatcggttcatgctgattcaaatcacgaaattgtttgcgcattccccgcaatttaactttaagctcatcaacggcttgctgataaggcagtaaaaaatgattccaatcttccatcggggcacctccgtttcaatccataccctaaaattttaccataaatcgtcggaataaaaagttaacgttctcgagattgaaccctaagttcactttttttccaaactgtaatcctagaaacaaaatactttacgaatttagcaaatcggtgcatgattacgggtgaaggtttaagctaagtaacgagtgattttctgcattaaaaaatttatgaaatgaaaaacttgcaaatacctcgtttgattggtattctgcactatgacgcgaatagagaaagtggaggaattataacgtgttagaagtgtatttatttgtaaatccgttggcaaaccaatgcgtacgtgatgagcaaaacgtgttacggttggcaaacgactcagacaagcaaatccaatttcaattcgtaccattactcaatattaatgtgattcaacgggctctaaagtgccaaggaatcaaggcatccgactggcatgctcaaaatcaacagtctcaaacattgtaccgagttattttggattataaagccgccctttttcaaggcaaaaaacgggggcgtaactttttaattgccttgcaatctgcaatgctcaaggctggtcaacactattcggaagagctcgtcaaaacggttgcaactaactgtcagattgacttagacatgttcatggaagatcgggacagtgacttggcgaaacaggcctttcatgctgatcagcggcttgcatctgaaatgaacattaccgaagcatcgtcggccgtcgtttttgattgcgaccaatatgattatggtgtcttgctagaacattttaattacacgactctttttgacttagtcaatggcaatctggatccttttcaagatgcaactcgggcaaccaatgccagcggtgctagccttgccaacgcacaattacacgttttataattccagtaattgcaattattcaactggtcctaccagtcaaaagcacccgacgatcattttcgccgggtgcttttgactgtatttaccttttatagctgccagaataagccttctggactcggcagctaacaccctaactgataagcgggtcaggtctaaaataagcgtcgggaccgaacatcctgacgctcattgtgcttgcttttataactggttaatcttgggtgaccaactgttcaaattcatttaatcgttcttcaaatacctcgaaagctgcatcaagataatcaggcttggtcatatcaactccagctcggtgcatgacatcgattgggaaagcagatgaaccagctttcaagtaaccgagataatccgcaacagcatctgtctgttgcgtactaatacggtcagccaacgttgaggccgctgcaaaacccgtggcatactgataaacataataattgtaataaaaatgcgggatacgggaccattcgtcggcaatttgcggatcactgacgacggcgtcaccatagtagcgttggttcaactgcaaataatgttttgacaagcgatcggcagtcaaagcctgaccttcttgatcttgctcatgaagccactgttcaaactcagcaaattgcgtctgccggaaaacggtgcctttaaatccatctaagtagtaattcaagacatacgcccgcatttttggatcttgttcagtcgctaagaaatagttcgtcaacaagttttcattagtcgttgatgcaatttccgccacgaaaattgaatagtcaccatactgataaggctgatgatgtgtcgtgaagtaagagtgcatactgtgtcccatttcgtgcaccaacgtatataaattatcaatattatcctgccagttcaacagcatgtatggcgcggtatcatacattcctgacgaatacgccccgctacgtttgccttgattttccaccacatcaatccaccgtgaagcaaacgctgttttgacgtgtttgagataatcaggacccaaaattttgagcgcttgtaaagcagttgcttgagcctgctggtaggaatagttggtcgtcggcttgggtgccaatggcgtgtacatatcatacatatgcaactgatcaactccgagcagttgtttccgtaacgcaacataccggtgcaataagtccaaatgcttgtcaacggacgtgactaaagaatcgtaaaccgccgtcggaatctgattggcagcaagtgctgccgtccgcgcatctggataatgatgagcctgggcaacaaaattgtgtaccttgacttggctagctaaagtcgaagcaagtgttcgccggaactggccgtatactttatacagtgcttcaaacgcctctcgccgaacagccggatgaacggactcaagtaacaccccataaattccttgtgacaatttgacagggttgccgtcgtcatcctttaccgttggaaattgaaagtcagcgttattcagtacaccaaaagttttcgcagaagcaccaaaaatatcactagcgcctgcgagtaaagcttcttcgctttcagacagaacgtgtcccttttgcaaccggatcgtatccaacaaatgccgataatcacgtaaatcgacgttttcatcaaggtacgtatccaattggcccggcgttaattccaagattgctggttcgaaccaggcagtcgctgcggataccttggcagtcaaactactagcttgatcgtctaaagccgcattggtactattgccagtatcctggtcacttttcagacttgcgtataccgccactttctctaaccgacgatacagcgctaaaacagcctggatgccagccagcaccgtgtcggccgagcttgtaaacgtttctttaagcgcagtgacggtggggattgcagctttgacttgtgcaatatccgcctcatacgcggcctgatctgcataaatgggcgtcaaatcccacgtcagttcttcaggaacggccgaacgggtcggcaattgtttggttactaccatgcaaattcctccaattatttcaatatagcactagattaccacagattgcgcctatcgcggtagcatctgttccggaatcaatgtttgcgccatcgaagctggccggaattcacatgccactcagttttctgccagtttatcacttgctgctcgctaagcatcgtaatcatggtcgttatcagttgttgtattaacgtgcctcgtgcttgcaggcaggcacgccgggcaagtaatggccgtaattgggcccagatcaatgcctctaattgtggcccagtaagccgtccggactgttgccgcagtgcaaaaaagacgtgggcgtgccagaccagatatggtcccgataacagcggtagttgcggcacagtgggcatcgtccacgtcggtaactgggcaatcgttcccccgcgttgatagcaagccacttgtaacgcatcaaaaccacgttgatgtcgaagccgtgccaacattagctgttgataataatgccgtaaatgcgtgtccggcaaagttggggtgttaatttttggagccaattggcgaaaatgtaacaccgactggctgcgcatatccagtcgaatcgtttgataggtcagcggttccgtatccaatgtcaagacgtgatgcaataaacgaacactagtactttgagtgtccaaaaaaagtagaaacaggccccaccgttgctggtactgcaaaaacttcaaagccttgctattgaggtgcaattgtcgctgataggggcgtcccaacaaccataacacttgatagccatgctgacgatagccctgcgtccgagctgcgagtcgctccactgacaagggtgaacactgaaattctaacgcgagtggttgcgctgtacctcgtcgaaccaagatatccgggcgctgatgtatctctggcaaaccagcctctaagcgcaccgtataaccactggcagcgaaccaggtcgctaattgttgtttaccacgaagatggtccgttgtttccccttcagagaaagcatcacaatccgtggcatggacgtgggcaaaatgtggcacgatcactgcccccccgtttcaatcgcaccggctgcacacatcctggacagtaatattctatttggcgatcagccgtcgccgcattaacgagttgatgctgggcatccatcgcgatcaacatgatggtccctcctttcaacaactaattacgtcattaaagccaattctcacgtaaacccatcatcatttattgaccccgagcagcacccgtcttttggcaaagcgtccggcaggcagattgtttatccgtggatacaaaaaagccttaacattacgaataaacgttatgttgaggcaattaactgctatttaaaatagtgccggatggtttccaaagcagcattagacatgatcttttcaccatgttcaagtagtacgtcagctgaaatattagctaaatgggcatattccaaggctactgcgacatcatctttgatagtggccgttgatgattgatcgacaaagaaaaccagttctagataatattggtcgcgatacttgaataagttagacgcgagtccctctggccggaataattgtgccaatgaaacaagatcctcaaattgatcgaatttcaacacgtattccttagttggtgtatcaggatcatccaaatacggatcgagatcattagtgtccttagttggattatgtgcaataccttgtccatcttcaacctgattcgtatccgtctgcatcagtttacgcttcaaataatctgaaacatcatcttgtgagtcgctatcatccgattggtcgggtgactgagttgctttagcaatcgtatcttgtaaattatcactgtttttgctaataaataattctaaaccatttcggtttggtaatacttggaaagttacggcatcattgtcctgaaattgatgatcaacatcaacttcctccaagatgctatagaagaaactttcaatttgcttatgattccctagtaaatctagtacgcgaataccgcgttcattgagatcatcatttccaataacgacgcgaatcgtatcttcgttgatgcgttccatctccattacagatccacccctttctaagtgtcaagggccataatcactatcacaattctaacttatttcagtttattgtaaagtaatctatctgaaaatacaaaaattggccaattagttaagctaactagccaatgataatcacatatttgctaattgttgtgcccgtaataattctaatgtccgaattttgcgtggcaagaagcggcgaatctcgtcctcattgtaaccaacttgcagccgcttctcatcaagcataattggtcgacgtaacagactaggatcatgagtaatcatgtcaaacaattcattgagtgacaaatcattaatatcaacgttcagttgttgaaaggcctttgagcgagtggaaataatttcttccgtccctgattcagtcagttgtaggatctgcttgattttttcaattgaaagcggttcggtaaacagattgtgttcttgaaaatcaatgtcgtgtgtctgtaaccaagccttggctttgcgacatgaggtacaacttggtgcggtatataaaataaccatcctgggtcctccttggcatcgttaatcaattttataacataattcattatacgctactcacttttaattgtgaataggtttaacaaaattaatttatttaaaactaataatctaaaatacaattattcgatatatgtattttttctattgaataaaccgcttttatagtcattcttgttattaattaattcgtatacaatttaattatgacttatgatatcaataatctattaacggtaaactgacagaaaaagcttagcaaaatgatttgctaagccctatcatactagccaagattcaattgtaaaaacttttgagcaactgtcacttgaatgtcattaccggcggctgcttgtgcttcttgttggagttgtgtaaatgagacatcttgtggcaagtgtgtgagcaataattttttgacgcgggcatctttggcaattttaccagactgtgccgacgtcatatgccacattttaccagttttatctgcggcaaaattcgtatcagtcatcaataactgtgccccggctgcgaaagtcgctaattctggcaaataagccgtatcggcggaaaagacaagttcttgccccgtcgctcgctcgaccaacttaacggcataggctggaactggatgtttagtcggtaaaaagctcacatcaaacggcccaatctgattgacagcagccggatcataggcccgaccttctgtggcattcgcccaggtcaaggcaccaaagttaagtggatcagcggtgtgcccgtaaatcggcagcacgggcgtcttccgttcaccagcacgcaactgccagtaatattgtaagaccccaacgtccgccgtatgatcgtgatgataatgagttaggagcacactatcgagctgtaaggggtctaaaatctcttctaaggcgtttagcgcccccgacccacaatcgagcaataaatggtaatcaccggctgtaatcaggtaagaactcgtacccacgccatcgtatggataaccaccatagtaaccaagaactgttagtttcattattgaccatcccttcatttctctgtccacttctattttaatatagcaccaagaaaaaatgaaaccaacaacttaacatattttcaattattttgaaaaacacgtataataatagatgtaataaataaggagtgatattgatgagtggaaagattgcagcaacatttgggacacgtaaaattctaaccatgatccaacaacaaaatgctgatcgtgacttgttattaatgcaggccaacgccactgaagatcgctatatgctactcgatttaaccggcgaaaaaaccgttttttcaagccccgtaacgtatgacgttttactttcaaaaggatcagctgactggcatggaatgacaagtttcatcttcattgatttaccggaagaagaacaaaaagtctttaaatctaagtttagtagtttccgacacgattataataagccagatgggctgaaacatttttggatcttacgtgagtccaaaaataattcagccttcgtgattgtcacaaattggcatagcgactccgaatatgctgtttggctgcgaagcgcttcattcaagccatttgccaagtacatcacctcagattacggctaccacgaaagtcgctattcatttgtacgttcattaaaatcataatcatccggtattggatatttcaagtcgctgcagtgattgaactgcaacgacttttttcatgaatattacttttactcaacactgctaaatctcatcagttgatatataagcctcgttcacaacatcacattgcagtcagaaccaacatatgtcccgatcagtgtgatcctaaagaatctgccgtcagctttagttgagcaatcgtgagcccaatcagccatctgttgaatgacacccaccctatttactgattacagtgcgcacctctttaggtgatctcgtcaaacagttaatattctgaaaacacaaaaaaacgtcattcatcaacgaatgacgtttgtgacggtccgtacgagactcgaannnnnnnnnntttcaaagatctaattccgtgcgttaatcgcttaacacaactattacataatatcatttcatcatttccttgtcaacaactttatttaagaagttgaataactatgcaaatgaatttgaaacgttattaccataacataatcgttaacacctcaatcagttgaattgttaacgcgacaagaaatatcttatcattagcgattactcatgtcaataacttttttgctgttttgaatatttattcacttacaacaatttgaaatgaaacaatgtaagtgctagcggctagctgtttaacagcagtgctcgcagcgacaagatatatattatcaagtattagtatgcaggtcaaccctttattcgaatttattttgataaattcgtaaacggcattgtttcactcacacgaacactcgtaaataactcgtgcaattcactggctagaacaaactcgagcccttgacgatcaaactttgcacgtacctgcccgtcaacagctagttggtcaaagacaaagaccgcaactttttcatcatccaactcagccataatcgaatcatacaagcgcaattggtcaacatcaataccaatcgtatatcgcaaatcccacaatactgacgctaagggcgaatgccctgctcgtactggcaactgataaaaattgtatccattagtagaatgcttaactaaaaagtgcgacccttgctggtcattatgaagtgaacccacaagtttnnnnnnnnnnaatctcgggggttcacttcattataaataattgtcccggcaacttttttctgcactaatactcacccgctttcaatcgatttagtgaatccgaagtccaactcgctaaatgattggcaattggttcaaagccagcatgaacatgccgattcgtccaaaaatgcttatgccgaaaagtcttgtagatttccaaatcattgaccgtcggatgcggttgatgctcgatacaacgtaatgacaagctgatttttccagtatattcgtcaatatctaaaataataacatctacggcttgaccaacctttagatactcagtaatacttttaacgtatccttcatgacactctgaaatgtgaatcaatccctgatgctcaccatctaaggtgacaaaagcaccatatggttgaataccagtgactcgtccgtgtacccgcataccaattcgataattgctcacgatcataccatcctttctcattcattctatattgtcgataattctaatccccaatattataacctgaatacagcggattgcaaaatcgtaattgcaaaaaaagaaacccgcagccgcagatttctttcaaactaactaatcctcaattgtaattgtttcgatcacaacatccttcactggtttatcctgcataccagtctcagtggccgcaatcttatcaacgatatccatcccatcactaactgcaccaaaaacagtgtgccggaaatctagccagggcgtgccaccattgccatacgcagtcacgatttcttccggataaccagcttgcttcatctgatcactcatcccagcatctaattgtggcttttgaacgataaagaattggctaccgttcgtattaggaccagcgttggccattgataatgcccctcgcaagttgaaaacctcttgtgagaattcatcttcaaatggtttaccccacaaactttcgccacccatcccggtaccggttggatcgccaccctgaatcataaaatcaggaatgacccggtggaagataatgccatcgtagtaacccttctgagctaaaccaacaaagttttcaacactcttgggggcctgctttggaaatagttgaaccttaatatcaccaaagttagttttgattgttgcttttggtccatcgacctgacttaaatctaattgcggaaatgccacaaaatcacccgttttctattaagattatcttgataatacaagagaactcgattaaatgctagccatttgtaaggatttcttgcgattagcgactaagcatagtattttgactgattttctggtaacctagataggattaatttcacattacttggaggtaaccatgagttttttaatcgattttgtgttgcacattgaccaacacttagtcaccatcgtgaatagttttggaatctggacctacctaattctctttgccatcatcttcattgagactggcgcggtcattttaccatttcttcccggtgactcccttttatttgcagcttgcgcactcgccgctaatccaacctatggcttacatatctggacttttgtcattctcttcttggtggcagctttggcgggcgactcacttaacttctatattggtcatttcctaggagaacgcctaactgaaacatcctggtttggtagactgatcaatcaaaaacagctggcaaagtccgaaaaattcttcgaaaaacatggtggcatcaccgtgaccatcgcacgcttcatgccaatcatccgaacctttgtcccatttgtagctgccagttcgcgaatgaagtatcaacaattcattcgctacaacgttatcggctgtgtcctgtgggtcattctctgttgtggtggtggctactacttcggtaatatcccgttcgttaaggaacacttttcgatggttgtcattggaatcatcctggtttcactgattccagctgtcttctctgctatccgcgcacgctttagccatccaactgaaaacgaagattaatccaattataaaaggccgatcagctaataatagctgaccggccttttataatctaacttaaaatgcagtgtccactgtaaatactcttcattaatccgcttcacgtaacgcttgtctgccgatactgagtaagtaaaaaaaagaccactcaatcaggataaacgctagaacaaagcactgaccgaagaacgtatccggcaagaccaaaatgattcggtccaatagtggatcgaacaaccagtccgaattgcgaaataagatcttatggaacatgataaagaactgatcaaaattgatagccattataacggtcactactggtggtacccagagggctgtctgcatcggtaatactaaccgccacaattgttgatcacgtcgtagtcgctgccaaaaaaaatagaccacaacactcgtgacgataaacacaccgtaatcaagcataaatagattcttcacatccgcaaagtgaaccaacgcactcgtcgaatccgtaaaatcgttcatagttaatttgggtacccacggaaagttaagatatgctaacagctgatagtagttcgtcatcagccgtcccaatgtcaaattcacagttgcgcctaacttttgaccaaccgcattggcaaaatacaaccagctcgcgttgattgttacaattatcgtgccactcactaaccataagtataaactcagccactgagccgcatttttaaatttatttagccacaccatcgtctaggtcccattcgtccaaagaattgatctcattagttggtttgacggcctgttgtgccactagttcaggggtagagacaccggtatacaccaataaggagtcaatcccaaagttaattgccgctgagatatccgtcatataattgtcaccaaccatcacacaatcgtgcttatcgagaccaatccggtcgaccgctttctgcataataattgtctccggcttaccaatgtaagttgcacgttgttgggtggcccgttcgaccatcgcaattactgaaccagcacctggcactagcccccgctcatttggaagattagtatccgcgttggtgccaatgaacttagccccccgcttaattgccagcgtagcaagttcaaatttatggtaggtcgcatcatagtctaaaccaacgattacgaatctaggtgtgcgctcatcgaacttgaagcccttttccaacattgcacccttcaagccaagttccccgatgacgtacatcgttttatcaccatcacctgcaaggtcattaacatagtctgcagtcgctaacgctgccgtataaacattcgcaggactcacatgaatatcatgattgttcgctaagtttgcagccacatcttctggtgatttagtcgtgttattcgtgaccaataaaaaatcagtctgactagcctgtagtcgttcaataaaccgtttagcagcaggaatacgttcccgaccacgataaactgttccatctaaatcaattaaataacccttgtacttacccaatcaaaatacctctctctgttcctacttttgtcgaatcgtaaagtggcgtttaccactactctgcttcgttgtttgcgcttgcttaccattaccggccgtaactttcgccggttgccgccgcttttcagtaaacggtgcggccttctgcttagtggtgaagctatgagacttccgccgttgtttgctgcgactactgttacggttactccgcgctcgggattgccgactattagtgtttttctttccccgccgatcatccttacgtgagcgactggtacgcttaggtttaatgacccgttcgtttttaatgataaaataggcgcaaccaaaattacaatattcgtacagatagtcttggaccgccccaatcgtctgtgagcgctggacatctttcatatcatcacggaaaaaaccttttaaccgtaactgttcaaaaccccaatcaccgacaatataatcatatttatttaaaattgagctgtagcgctcaacgaacttgtcgaggtcaaacccttggcgataatcgtacacgatttcaaacgggtgcttgctaacttcaaagtgggtcttatcagttcgtaatccatgatacaaattgcgccgccgttccgcttgttgttcagctagttcatcaatatgttcgcgattcacattgacaccacctttctcttatttaaccggccatcgacgcattaagtaatcgccaacgaccgttcttaacatggcttcaaataatatctcagttcgaccactgatattaatggtcgggaaaaacggaatgaataaatcatgatctaataacgcaatctggtacgtttgttgccgattgaccggctgaccattcactagtaatgtatgctgtcccgttttccacgtgaggccctggtactggatataaccaaagacttgaccacgaaatcccattcctttaatcggaaatttgttcaaaaacgggcgaactaactccatctcatagactaagcgccacaatgcttcaccacttaacgtcactcgaataacatgcatcgcgtgaggtagcatggtatgtaaatcatttcggttgaccatgcctgcgggaagatcccgcatgaacaggccaccgttcaacatacctagatcagttttggcatagtccgtaatggccgctagcccgagggccgtcaaatcacttgcatggtgccaatgtggccgcagctgcgtcggcaccttcgcaacaacttgccgcgtgagtaacgtttcaccctgttgctcccagccagtaatcaacgtttcatcaccggccacaattggtaagctggccgtggcaacagtatgcgccgcggccgctttaacgtgatgttgatgatcaatcgtcagttcaattcgcccaatatactcaccgtattttccagctgccgctatcaggaccccatttttcagttcaccgttcaccagtaaatgatgcgtatgactgccaataacaacatcgatcaccggaaactgttttgctaaccaccgatcgacattgataccaaggtgggacatcacgattaagacatcatattgccctgcatattgtcgtaacaactctgggaatcgcgtcttaacactggccggcgtccaaccgttcaacgggtaagtcaacgtaaacggtgccgtaaatgccagcaacaagactcgtgtcccccgtgcagttgtaatgattttagctggtaatgcccactgcggcggtcgttgcgttgcagtatctgtcaaattatcgagaacaacatcaaagttggcgcggtcatacaaccggtttaaggccgcgtgcgttaaacccagtccttcattattgccaatcgtgaccgcatcatagccaatcgcgttcaataacgccacgttggcctgcccttgagtggcttctgagagtggatgggcacgatcaaccgcgtcgccgaggtcaaccgtgatcacatggcttccagattgccggcgctgctcacgttcggttaataaataccgttgaatacgtggccagttttcaaaatgcgaatgaatatcattggtatgcagaatcgtgacttgctcgtccacggtcaatcgcccctcaatcgttgtctttgttaatcctaaagcattcaccaaagtcggtcaagcactcgcttactggcgcttggcaaaatcaatggctttaccgtcaaccatctgctcgatctcggccagtgaaaatggcgttccaaagggcaccggatggtccaagtaatcgacttctggtgtatcgacacccacgttgatgttctccttgacgttgacggcataatgatgaatatgcccgtgcaaattgataatttgtttgacgatccccatcatcattgggtagtgcgtcatatagtattggcggtggtcgtacttaatcagtacccccacgtcgtgaaactcaaacttcggttgaccattcaactgtggatcatgagcagccaaatacttaaagaaggcccgtgaatcatggtttccctttataaaaatgattttgccatttaactgtgctaagagtgcaaaaacccgctcataagacaatttcgctggtcgcgtaaaatacagcgcaacatcgcctaaatgatagactgtatcctgatccgtcacacgggcattccaatggtcaacaatcgcttggttcattgtctctacatctggaaatagccggggcgcaaagtcgttgtcccccaacaaatcagcatgataaaaatgtgtgtcggacgtaaaatattgcatcgttcaaacctcttattcgtatatttacatttgtaacatcaatcggatgtgtcatgtctagcgaatttcatgacttttgcttgaaaagctgacttatccgttcgtcagcatatacccatgtcagtcattcgaatcctattacgactgtcagtcatcatatggcacactaactcggcaagtttatactaaacaaaccgtttccaccgagtcaaagctgacagttttggcacttactgaacagcacgtattaatcatgaaccattttaaagaacacctgacacaacgcgttagtcatttatcattgtaccgcgcaccgttctaaaagacactagaacagttttaagtttattgctttgtcagcactggaaccatgttttatgaccaacccatattcacaaatctagctaatatcgtcaaaaagtgcacttaactgcaatcggcagagttaagtgcacttcataaatcccattagttaacctacttgatagccaatcagcactcctggttattgctgactagtcgtgtgtccgttgacgaattcggtcactaacgatcttgacaatgtataagccaaccacccagaccgctgacacgagtaacgcgattaacgtttcaaacttcagacagagaacaacagcgataaaagctaagaacactagaatgaagtaatcagataacggaaacagtggcatctggaatttcactttagcctgactgcccgcttgacgtcgatacttgatatgtgcgacgacgattgcgccccaaataaagataaaacaagtagtcgatacactcgcaatcagcgagaagactttcccaggcatcagtaagtttagaattactgacaacccaatcaccagcgtcgagaaccataacgcattgcggggaacttggcgggtcgatagtgtccccattcgtttggcaaacttgcttttgtcatcatacgttagtgagaataacatccgcccggtactgaataacgcactattacaactagaagcggccgccgtgagcactacgaagttgataatcgcagccgctgaacgaattcccaaattggtgaatacttgtacgaacgggctgtgtgccgatgaaaagtattgccacgggtacatacacattagaaagaatagtgacccaacataaaacagaatgatccgcacgggaatatcattgattgctttgggaatcaccgtcttcggatcagccgtctcagaagctgtcatgccgaccatctcgatcccaataaaactgaacaggaccatctggaaggaaagcactaagcctttgattccgtgtggcataaaaccgccataactaaccaaattggttaagctggcgtggcccacaggggtcttaacgctaaacaagaccataccaatcccaacagcaattaatgccaagatagcagcgatcttaataatcgcaaaccaaaattcagtttcaccgaacgctgagacattaatagaattcaagcccagcaataaaatcaagataatcagccccggaagccattgcggtaacttaggccaccaaaactgcatatactcaccagcagcagtaatttcggccatcgcaatcgtgatccagcaaacccaatacgtccatccagccacaaagccggtcttatcacctaagtattgcttaataaaatcaatataagaatgcgtatgaaggtcagataacagtagttcacctaacgcccgcattaataaaaagcacactaaaccggtcactaagtatgcgatcaggatcgctggccccgccaagtggatagattgaccggcccctaagaacagtccggtcccaatcgtgccgccgatggcaattaattgaacatggcggctttttaagcctcgcgagagttgttccgtcgcaggctgtgaattttctttcgtcattatctttgcactccccttgaaattattatagcggccaaattcctagcattcaaaaggacacgcttaagaaaatcacacgattggactataccattgttcgctaacgaaattcatcttatgtacgcgtaagcgtttgctaacttgcatggctgggattcagctttgttagttgactaaaccagtgaacgctcccgctacgtgaataaagtgaaggcaacgcatactaacatgaataactttcacttcagcatctaaaaaagcacccggattttcatccgcgtgcctctttacaaccttaatcatattgaaacgatgctgatcactgattctgagccacgcgctcaacatcgcgggcaatcataagttcttcatcagtaggaatgagtaacgtccgaatcttcgcatcggtcgtactcaggtcccgttcgacaccactgacttgattcttagtcgggtcaatcgcgacgccaaagtaggtcaaccgatccgcgattcgttgtcgcatccgtgcatcccgttcaccgataccagccgttatcactaatgcatccgcaccttgtagctcagccaaataagcaccgacatacttaacgatccgattgacaaaaatatcaatagctaactgagcctgtgagtcctcatcataacgtgcctcgagctcctgcatatctgcagaaccagctagccccagtaagcctgactgcgtattcaaaatcgttaacatttcatcaggatcgctaatattaagctttttcatgagataagcaaccagcgacggatccacatcgcccgagcgcgttgccattgtaataccagctaacggcgtaaatcccatcgaggtatctagtgactgtccatgatcaatcgccgtaatcgaacttcccgcacctaaatgcaacgtaatcagcttcaacgtttcgagcggtcggcccaataatttagctgctcgcaccgcgacgtagcgatggctcgttccatgagcgccaaacttgcgagcaccatatcgttgatagtaatcatacggtaacgagtatagatagttaaccgccggcatacttgcatgaaacgccgtatcaaagacagcgaccgcgggcacatgtggtagtacccgcttgaaagcacgaataccgaccgcattagccggattatgcaatggcgcatattcggccagatccgtaatctgcttaagcacttggtcagtgattaaaactgaatcatggaattgctcgccaccggcaacgacccggtgaccgaccccagtaatttcatcatatgagtcaataattcgcaatttaattaactcatccaaaacgatattcacggcagccaaatggtccgcgactacggctttctcttggtaatgatgatcaacgccatagcgaatattgaccggtgaagttttgaatccaattcgttcaacagcgccctgtgcaatcacccgttcctgtggcatttcaaataacttaaatttcaacgtcgaactaccagcgttgatggcaatggtcttccccaaacgacacactcctagcgaataatattctggtcgacccacgcatcaatttgagcggtaaacgcttgaaaggcacgttgatcctcaaatgatggaaagtcgcctagtaatactttacctgcttggtgggcccgttgtccatgtttctgtaaaacaacaattgattttcgtgatttttcatcaagaaaaaggttagtcggcaagttcaacagaccttggaggtaagccgcagtgctcatccattttaacagtccttgagactcttgcgactgaaaaatcgtcgttggaacaaggaaaacaccccagccgcccggtaacaaatgagccatcgcttgctccatcatcaaatgatgaatgtaagaatgaccattcgtcgctttcgtttgaaaaccttggacacggtcatccaatgggtagtaccccactggcaaatcaccaattacaacggtcgttttcggcatgaccagggaatcaattgcgtcttgatgaaacaactccactgctgatcgttggagatccatgctcatcgcggcgattgccaactgattatcatcattatcgactccgtaaccctgaatcggacgtggccggtccgtctgcaactgatttatgaccgtagttaataagttaccagtcccgacagcaatatccaaaattgacaaatcagtcgtcgatccaactaacttagcaatcaagtatgccgttaacagtccaatcgaatctggtgtcatttgatggtttggatcaacgtgatcattatgaatcgcctttagtaaggccaactgaagcgcacgccgaattgtttcggcgtccaattgttttaagtcgatcgtttgatagagctttgttaaagctgccgtctgttccggatttggcttgccatcctcaacatgtacagattggcttaataaattatcgccagtctcaatgagcgcatccacgtaagaaacggatagttgttgcatcaaaacttgaactgattgatctaagacctgaaaaagcgtctcggtttctgcttgtgccagaatactcaccctcccgcaaaatctgtaatccttaaccatattactgattttacgcgttaagttcaagtcacggggttcactcaccaatcaagggagcgaattatgctgataagggtgctcataggattgtaaaatcaagcgatataacgtctggcgagactgaaaattaacgtatcgttgggtttcaaacgccccaccaattaacaataagctaatcaccgaaagcaggatcgttccgcgtcgcttcctcatctaccattgtcctccgatctggtaacagtaattgggcttgaaaatgaatccccttatcagtcgtcatcgtcagggtcaaatcatcggccacgtgaaattgccgaacgccctgcatcagattgatttcaccaccaccatagtggcgcaatccgattcgatgtaggatatgataataagtcaataaatactgtttgccggtgaccgtattaaccaaatgaacggcttttcccggcgtcagaccaccctcatcggaaatatggtccaccacaaaatggtgatccggattttcaagctcgtgaagcatcaaataccaatccactgttggcaaatccacttgggtgcgccgggccaaattgcgctgcccctgaaaaagtgtcgtcagcactacggccacgattgctaacgacacaacggcttcaattaacgtaaaaccgcgccgcctaatcatgtgcttgctccggtatcctggataatagctgctgacgttgccggtcttcatattgttttctggctgtctgaatcgcctgcaaggtctggcgttcatgtgactgcatcataatctctaaactttcaaacccaatcaaaccacccatcaatagccccagagcagtaatcgtttcaatcatcaaaaaacccattcgcgtctttaacatgtgtgactttataggccccccaccccatcaaagcattcagtttgattttctgcttcggctgtaattgcgacttgaaaataaccactgctagctgtggatgcccatttttctggatttgaatatcacgaccgcgctctgtttttaatgttgcaggcagtgggagatgccactgtgggccactgataggccgcccccgcttgccaccccaagtcacgacttccgtgccacgaaagctcacgacctggggctgacccgtcacactagcggttaaggtctgttgctgccacatcgtttgtaactcccgccagaaagcctgttccgcattctgttggcgttgccgtgtgggaaaacggtgcacagcaatcaccgccacactagccacgatcgccaagaccgctaccgtttcgattaaggtaaatccctgtcgcttaaccaccaactactttttgtggttgcggccgtaccggactaatgccctgtgacttagcctgcttatattgaccatcgttaatatatcccttgttccgaagttcttctaacattgcgtcgtcatccgtgacggtcttacccgtatcattcgcatacatttcagcctgattttgaacaacttcagtcagggcttcttgttggcgaccagccgcctgtttacgttgttgattcaaattgggcaccacgatcaacatcaagagactgatgatcgccaatacgatcaccatttcaattaaggtaaaaccgcgctgtggtgctgccgtttttttcatcaagcgtttcattaataatgtcattttaaaatctcccccattgattgatacatcggtaataacaaactcaagtatgtgccgacaacgacgagtgcaataatgccaaacatgatgggttgaatccaaccaatcatccggttcaactgtcgaatcaagcgttcgtactgcaaaattgcaaagtatagtaattcctgacttaactgttctgccggactctctttgccgaccagtagtgctaactcatcaggtaataatcggtcctcctggataattgtgactaacgaagtcccagtcagtaacgcctgttcgataacctgcccttgctgataaatcagcgccttagtttgaaagtgctgactgacttcacaaatgccacgaatccctaaaccaccagtcagcagcatacccgcattaaggcttaaatagtaaccacagtagtttctgatcaggggaccaatcaaggggacttgagccaaccactgatagcgccgccgaatgggtaatcggctaacttgaaggccaaccagcaataagcaaatcaccaaggtaatgaccgtgataccgctaaaccattgccaattcgcgattgtcccactaccattaccaccatgagcaagactcggtaaaatcgcagctttgaccgtgcctaaagttcccagcagtagaattaacagcagacaagggtactgtaacaaccgccgaatttggcgtccctgttcagcacgcgctcgcattaattgacctgcctgcatcaaggtccggcgtaattcaccatgagtctcagcaattaagaactggtaatacaagtccaccgcaatgtatggacgcagcgccatagacaaatcatcacccgcggctaaacgccccagcgcgggctgcaaggattgaaaggccggtccttctacatccaatgtaaattgaaaggcttgctgaaacgagaagccgttgcctagcaagtcggctagcgtttcaaacagcttcgcctgcatagcaatcggaagccgtttacgcttccttaagttgattggccgtcgcatgatcgagacggcccgctgccaattgttcatcaattaactccgcccacctttcagtcatcatttgcgacgttttgggccttgcatgcggtaacacgaccgtatcgaaaatcgtcgccacgctgccatccgtcactggtacgaggcgctgataggacattgcagttaaagcctgctccaaaacagcggcttccactcccaattgcgtcaaccggggaataatcccgtagacaccgcgcgcatgaatagtacttaaaactaagtgaccacttagcgctgcctgtaccgcaatccgagccgtttcagcatcacgaatctcaccaataataaagacgtcgggatggtggcgtaacccaaccttcagtaagtcgccatacgccatctgggccggcgcgtttacttgtagttgtaaaaattgtggttcataaatttcaaccggatcttcgatcgtcatgactagccgttggccacgaagctgccgcacaagatcatacatcgtggaagttttgccagaacccatcggcccggaaaataagatcaatcccgttcgtcgcattaattgactcaattgttgccgttgctgtgggaccaaatagctcaattttcgggccggaccttcatacaataaccggacaaccaacgactcacggtccaaaaagtcgccaactgccgagattcgcaaatttaaagtttgctctgccaatgttaacgtcatcgcccctaattggggccgccgatgatcactaatcgccatgttactacggtatttgatgtgattcatcaattgctgggccaactcagttgtaatctgagtaagtgcccgcaaactgcctgctgcttgcactaacacctgatacccttctgccgtgggtaaccaataaatatcactggcccgctgattcacggctgcctgaatgatttcgttcaactctgcttcaatcaccatttatcatggtcacgctcctttcaatcattagtttcgtaacaacgaccactttccacgaaaaaaatgacatttattttggcatcaaaaaagctgttccagaaataacaaattatttccagaacagctcgtcatcgcatattttcatttgcaatcctaacatacggcgttataagcgccccgatataaaccaattaaggcgttaggcccgctcagccgcttcaatgacttccttagttggaatcgatggttgcgcacccaatttttgaacagctatcgaagatgcccggttggcaaaccgtaccgcagcggccaaattactaaagtctggcattaagaccgaactgagtgcaccaataaaggtgtccccagctgcagtcgtgtcaacggcctcaaccttataagctgggacgaagccgtgctcagcaccgcgcatccagaaagcgcctttactcccaacggtaatgatcacgttagcaacgcccagcgcctgcaacttctgtgcaccctgaatcatcgattgctcatcagtaatgtgcacgccagtcaaggtttccgtctcagtttcgttaggaacaattaagtcggtcgtcgctagtaattctgcgggcaccgtcgtcgtagctggtgccgggtttaaaatcgttttttgcccagcggcctgagccaattcaaaccctcgaatcgttgctgcaatcggcgtttcaaactgtgcaatcaaaaaagtactagcgctaattgcgggttgggcccgttcgacatcttcggccgtaacctgctgattagttccaccatcgattaagatacggttctcactactactatctaacaagatgaaagctgagccggtactagccacattgctatgttgaacatattggtcattaacaccactattcgtcaactgctgcaccataaaggccccttcctgatcagtaccaactttaccgataaaagtcgtttgggcaccagcgcgcgcggctgcgatggcttggttagcccctttacccccaccagcgacactcttaccagtcagcggtagcgtttcaccaggcttaggaaaacgcttgaaacgcaaaatcgaatcaacattcaaactacctagtacggttactttattcatgattattcgtcccttcagtattcaactgctctaattttagcaaactggcctgttcgacgcacttgttttactaatattttaagcaataaaaaacgtggttcttgatttatcatcaaagaaccacgtcttttcatcattaatctgggtagttagcagcttcgtatacttctgatacgtcgtcgttatcttccaattcatcaatcatgtgttgtaacttttccactttatcagcaggaacgtccgttaggttttcaggaatcatggttaattcagctgtttccaacttgtaaccattagcttcgagggcatcacgaacggcagctaattgtttaggatcagtgtaaatttcaaacgcttcgtcgcttgattgtaaatcgtcgccaccagcatctaaaacgtccatcaacatcgtatcttcgtcggtatctaaatcttcgcgactgatcacgatgtaacccttacgatcaaacatgtaactaaccgcaccagttgcggctaaagccccaccatgatgcgtgaacgctgaacgaaccgccgcagcagtccggtttttgttatcagttaatgcgtgaaccagaacggcgataccaccagggccgtagccttcgtaagtaacttcttcgtagttctccgcaccggagccactacctttatcaaccgcccgtttaatattgtctttaggcatgttggcagctttggccttatccataactaaccgcaattgcgcgttagaatctggatcaggacccccggcttttacagccatataaagttcacgggaaatcttttgaaagactttcccacgtttagcatcttgggcgttcttacgtccttgaatgttatgccattttgaatgtcctgacatgtgtgactccttctttcatatttattttcagtttagtagataaacatacgtaaagtatgatagcaaaaaaagcgagcgatttcaagcactagaaccaagggcgtccaagttctgcgatttttattgcaaatctaatgaaccagtttcgttattggactctctttcagatttgaaatttcagtttgctaatgacaaccacaaccacgacaaactggtgttatggccgtaaatatgcgtaacccacagcttgcaagtccacgattcgcaccacaccagcgggaacgaccgtcacactggcaggaagttgggccgcagtcatttgatgactcaccatggcattatggcaagcatcaatctcaacttgcggtaacgtctgttgtaatggcttccaggcaccagttaccagcgtcgtgatagcgggcccgttgaccacaaccaccaccgtactagttggccgggctgccaaaaaattctgcacattgcttatggccgttgcgaccttagccggctcgtcgacatggactactaagttagtcattcgcttgtcctccctcgatcgaccgcagttcgagtgcgcgtagatagtgatagctactcaacatgttagcgcaggtcgcatccgtttcatccggcacttcataaatcatggtagcgtgcgggttgaggactggtaacacccgctgccagtcaatcagtccctgccctaaaggtaaactatcgtgccgcgtccccatcgaatcaaccaaatgataatgttgaatgagtggagccagccgcttcaaagccaacatggtcaattccatatcaccgtgcagcgcaatgaagacgtggctcaaatcacaaaccagcggataatgatgctgaatgatacgctcatctaactggggatcaccatacataaaacttgccgttaccccattttcaatcacgacatgtccactcgcctgacgaaccaaattatccaaccgctcaaagaccacgtcacgtgcaacctgcaaggactcatactcatcgatcaagcgcccactgtcgctaccatagccaccgtgtacgagcaccttgacatccaattccgtcgccaacgcaagtaactgggccgtactcgtttgtaggaattggtacgccgcagcttcacgatgtggatcaagcaattgatcaagatgaacgccttgataactcatagggtgatgaatcacaatttgctcggtgacagttgtctttacaaattggacagctgttttaagtgtctgaaatgcttccggttcaaagtccgtggcactcgtaaaaaattcaaatacttcgggccggtattgcaaacgatccattaattgtgcgggtgcttgggacgccttcaagcctaacttaatttttccgggccgtggccgcattattagttgtgtcatccgtttaactcatcctttcacgcattccaaaaccaaaaaaggcttggaataaatattccaaacctagtataacgctatcgttctaaattatgccaacgtcactagctggcagacaaccgaacttaatcagcagacttggttgagccccgccgaacaatgccgtatggcaaggtgaccgtcttctcgtcaagttctttatcgttcatcaacttagttaacatccgcatggcaaccgcaccaatatcatataatggttgggtaatcgaggtaatggctggacgcgtgatttgggtaataatcgtatcattactcgtcacaacttccaagtcatctggaacgttgatcccggattccatacttgcgttgataagaccagccgccatttcgtcgtccccaacgaataccgcagtagcgccactatccgcaatgactggttgtaacttccgcccagcatcatatgagtagcccgcttcataaacgagggcgtcgtcaaacggaatcttagccttggttaaggcccgtttgtaacccgtcagtcggtattcagcgttgattgattgtgacaatgagcctaaagccaacgcgatcttcttgtgaccacgtgcaattaagttagtgaccacttcttcaacagctgcagcgtagtcgatattaacgcttggcgtttcattgttcggatcaaccgtcccagctaaaacaactggtgccttggcccgtttgaattcagcccggagcttgtcatcaatatggttacccataaagatgaccccgtcaacttgcttagccatcaacgtattcaacacgttgacttcttgttcacccgcatcatcggagttcgttaaaatgatattgtacttgtacatcatcgcaatatcatcaatcccgcgtgctaacgccgcaaaataaatgttggtcacgtccgggatgattaccccgaccgtagttgaacgcttacttgctaaccctcgtgcaactgcgttaggccggtaatctaaccgttcaatgacagctagtacctttttacgcgttgcgggtttaacgttgggattaccattgacgactcgtgaaactgtggccattgagaccgccgcttcgcgtgccacatcataaattgttactgtttgtttttccatataaaaatagccctttcttgcttggtatcatatgttttcatccgttttcatgcaacatcaaccaatatagcaaaattacgcttccaatgcaacttaagattgttattgaaatcgctttcatgaaaataataccgtacttgttttcaaaatgcaagatttaccacacgaagattgttattttgggctcattattctcagctttttatcatcaacagcgctatactagtattattatctattattttatctaaggagtgtttgaattgacagattatacgaaactgcaacaagtccgtcaatggacccaagacaatcacgttgacgtgacctacatcagtaactttcacacaatttcatatttgactggttttgagagcaacccctacgaacggacgctagcactgtttgttttcgcggatgcggaaccatttctctttgcacccgctctcgaagttgaagcaatcaaggagatgggctggccttacaaagttttcggctacctcgaccatgaagatccatacgcgctaattgctgatcacattcacgcacaattgactgatcctaaagtttgggcctttgaaactgggaacttgacgttagaccgctttaccgcgctcaaacagcaatttccagctgcccacttcgataaggatctatcaccttatattcagcaattacggctggtcaaaacagctgatgaacttgaaaaactaaacattgccggtaaatgggccgactttgcttttgaacaaggatttgctgctgtcaaggcgggtcgcaccgaacaacagattgctgccgaattacagtatgccttaatgaaaaagggaattatggaaatgagtttcgacactttagtccaagctggtgaacatgccgccaacccccatggtgcaactaacgaaacccaagtcaagccaaatgaattagtgctattcgacctcggcgtcatgtatgaaggctatgcttctgatgcttcccggacaattgcttatggccaaccgagtgccaagcaaaaggaaatctttgacgtctgtctggaagccaacttgactgctcaagcggccattaaaccaggcatggcagccgaagatgtcgataaaatcgcacgcgatatcatcaccaaagcgggctatggcgaatacttcattcaccggttaggtcacggaatcggccaaactgaccacgaatttccttcgattatggctggtaaccacatgccactcgttgaaggcatgtgcttctcagtagaacctgggatctacattcccggcgtagctggtgttcgaatcgaagactgtggggtcgttactaaggaaggctttaagccatttacccatacgccaaaagaattaaaagtattagatctttaattaaaaacgtcaagagggccgtcacgacataatccgtgacggccctctttttttacctagcgttgactggtacttgcttttagtgttattccggtagcggatgttcggtttcatcatcagccacttcggctaacagtgccgccgtcgttttcaatggcagcacgtcacagtcaaccgcggcttcactccccgcctgactcgcacgccgataaacatcaatcttatgattgactttttgcaaattcaacaaggattgatggatttgcgcttcaacagcctggcgttgctcttcaaacattgctagccgttgatcaatcgttccatccccatcggcacaccaactaataaattagtgaatccaagtcttcatcattgaagacccggcggccctgcttatcacgcttcacaaagggcgttaagcccgccttatcataatagcgcagtgtataacttgaaataccggtctttttggcgaccgctccgattgaatacaatgtgattcctcctcaaaagcagataggacaccgagcacttgctcagtgtcctatcttatcgctgtcagcttacttggctggtgacgattcatccgttgtcgattcatcatcagacttcgcaggtgttgcgtccttagcaggtgctgattctggtacgggcgctgaagtcttctcgtcctcgccagctttttgataagcagctccaccatcaatgacgatatcttcatcatcaccttcatcatcttcgaccttagctaattcagaccgtaaactatccgtagcttggtcaagacttgagccaaagctttcacccgtttcctgcttagcggcttgatactggtcagcaaaatcggccacttttcgctttgtatcttcaaattgttgcccagcttcagccttgaagtcttcagcagcatcgttggcatagaacgcatagtcgattgcccgatccttaaaatcggcaattccttgctgtgctttagctttcaattcagcctttttatcatcatccatcttcataacggcggtagcaatcgctgcaccacctaaaacaacacctaataagaatccctttttcgacataattaagactcctcactattattttttgaacgtcgattacgatagacatcaaaagcggctttgccgaccttgcttgcgctggagaacttgctccgcttctcattgttcttgccaatcttggctgttaagtctcgagtcgcagcatttaagtcagagacgctctgacctaagtcgcccatcgcttgaaacgctggatcaattgttgcaactttgccgttaacatcctttaagagttcattggcatttgccatgattttttcagtctcatgtgacaaggcgtcaacatcatccgtaatattatttaaactacggttgacttcccccatcgttttagtaatccgcattaaaaaaatcccgataaagcatactaataataagaacgcaatggcggcaatgatgcccgcaatgtgtgtaatcatcctaaaattcctccttcaacagccatgatattaaaactagcatagcattgtctttagtataccgcaattaaaaaagtgcttacaacattcacccagtcacatttggtcgcaataacttgatcacggcttggttgcccgcgtcaaatctgataaactagtgaacagacaacaataacgagggtgaagatatgtttaattcaattaacctagcagcggttgacacaccgactaaacaagtttcggtgtggatgaagttggctaagaaaattgactggcaacaaattattattaatattggcggcaagctactcgaaatcattttatttattttactattttgggtgattgatcggctaggaaaacgcctgatccaccacttatttttaacgaatgctaataccagtgatactgccaataatcggatttcaacgatttttacattatcattaaatatctaccattacgtcatcatgttttttggcatctatgcggtactttcagtgttaggtgttcccgtggggacgttgattgctagtgctgggattttcagtgtggcgttaggtttaggcgcccaaggcttcgtcagtgacattgtcaccgggttcttcattctacttgaagatcagattgatgttggggattacgtcaaaatcgaaaccattgaggggaccgtctccgcaatcggtttacggacaactcaagttacgagtcccgatggcacgttgaactttattcccaatcgcaagattttaatcattagcaaccagtcgcgtaacgatatgcgcgtgctgattgacctctacattctcacaacgactcccgttcaagatctgactaacgtggtccgcgaaactaatgccgacctcgtgcctcagtatcctgatatcatcggtgagcccgacattcaaggcgtcacgacacaagccgatgggacgttggtcttccgagtacaattttacgtcaaaaatggcatgcagttcgcaattcagcgcgactttttggccgcctacttgaacgcggcccgagcagcgggaattcaactcccctcgccacgtttaaatatcgccccaacgcacaagtaagctcaaccaacacaagcccgcacagcggttgctcagaaatgagcgccacggtgcgggcttgatctttcatctgacaaatttcttcaggtgggaaccatgacgcacgttgttattgtcaggaatagttttagttattcccattcgcaacctaacgtgaccaggcgaaaactattgtgcggtcacaaccaaccattaattgcaacaacgctcggcattcttgaaactcaaaaacgtactgacacgtgttagcgcagtacgtgttgtaatttatttgtgtaacgcattccgatgagtcaaaaagctggtcatcgcattgaccccactcataatggcagccgtgtgcggcaccatgttttccgagtgcaacgaatatggactgtcgacccctaaccagaacattgtccctggaatctgatgaatcaaataaccaaagtcttccccagtcattgctggttccgtttcaataaagttgacatcatcatcctcctgcatgtacttgataaaatcagcagtgattgcgtcattgttctcaacgggataataaccaccttgattgagcttcaaatcgatattgcagtcataggcgagcgcaatcccctcagtaatcgtccgaacccgccgctgaatatgcatgttcatctcctgcgtcaacgctcggatcgtcccgtcaatctgggcctcaccggcaatcacattgccaatcgtgccagcagtaaagtgacctaatgtcaccacaccactttgaatcgggtccacgttgcgcgctacaatcgtctgcagctgggagactaacgccgcaccagcgacgaccatgtcgtttgcttgatgtgggtaagccgcgtgtccacttttaccacttaagtgtgcgtggatctcacaagttcccgcaaataacgtgcccatccggcaaccgatcgctccagttggtaaattaggattgtcatggaatgcaaaaatctcatctggcatccaatcaccatctagcgcaccactttcgtacaagcgttgcccacccgaggcattttcctcagccggctggaacatgaaaaccatgtcggtcgcaggtcggttctctgcaaagtagcttaggattcctagcgcgactgacatatgaatatcatggccacacgcgtgcatgacacctggatgggtcgatgcaaatggtaagcccgtattttcagtaactggtaacgcatcgatgtcagttcgataaccgattcgataatcatgctttaaaccactgactttcactaaaatcgccgtatccaaagtaggaatggttttgattgtcagccactcttgaggcatcttaccaataatcgacaataaataagcctgtgtttcatgttcttgtaagccgatttccggaatttggtgtaagtgttgataaattggaattagatcggtttcccgtaagaccattgtttatccctccaccattaaagattccgtaattctgccattaattcagtcttgctcttagtcttatcatcaatatctttcaacttacgagcaggaaccccaccgactacggtgttaggagcgacgtcttcaatgacgatcgcacccgcagccacaacggcacccttaccaacatgcacgccttcaagtacggccgcattggcaccgatcagcacgtcgtcatcgatttgaactggtttagccgaaggtggctctaccacgccagctaacacagtaccagcgccaatatgacagttcttaccaacaattgcgcgaccaccaagaatggcacccatgtcaatcatcgagccttcaccgatttcggcaccaatgttgatcaccgcacccatcatgataacggcattatcaccaatcaatacttggtcacgaataatcgcaccgggttcgatccgcgcattgtattgcttcaaatctgccattggtacggctgaattgcgcgcgtcattttctaattcataatcttcgatatttgcagcgttagcctttaagaacggttcaacatccgcccagtcaccgaataataccccagcgttgccactgaagaaagttttgatgcctgctggaacgtttaattggtctaaagcacccttcacgtatacttttacgggtgttttctttttcgcactgccaatgtagttaataattgattgtgcatctaattttgccatcggagaccctccaaaaatttatttagctttttcactagtggaaaaatccttctcaatcatatcatattgtttgccgatttcatgggtcagaaagttaaaactcttcatgaattcacgacgagtgacaattccttgaaaaatttgctgttcatcaacgactggaacaaacggattatcaatcatcaagtgtaacgtctcttcaacgtcatccacatcatgaaccgtcttaacttgtgtctccattacgtcacagacacgtttttgcagtaatatttcagtattcagttgatcaaaacctaacatttgttcagtaatcagtggcaacgatactaaaccttcaaagtgaccaccatgatcaagtactggaattttggaatacttgaccttcgttagtactaaaaacgcgtgatacaaattattatcagtttgaacgttggcaaccacgtccgccggaatcaaataatggtcggcgttacgtgacaataagtcctcaactggttgaattaacatacagcgcctccttcactaagcccatccctttattttaaccgcaaaagcactttgcacagccctaaaaatcagtttttttaccacattttaatcagcaaaatgaaattttagttctggcaccgcttgtagttgccgatcataatattggacgtcgatacctgcggctgacgttgtcacgatggcgtaggtgccaccgatacgtgcaaattcaccacgcggataagtaatactaccaggattaagcacgaccacgccgcctcgtcgttcaacacccagttgatgcgtgtgaccaaagaaagccagcttcgcattgtgcacctcagcattagctaatagatggtccaatcccatgttcacaccgactaagtgaccgtgcgtcatgtagactgtcacctcatcaatagttggattcacttcatttggaatcacggcatcgaaatccatatttccttgaaccgtgaacatctcttgaaaaaccgcgtcatcatgcggtaattcagaatcaccacagtgaaaaaaggcgtcgacctgaccgcggtacttatcaagcaatcgaactaacacgtcacgatcgccatggctatcactcactactaaacatttcatgctttcgcccaccattcatcgaatttagtcatcagttgtcgcaaggctgcaccccgatgactgatttgatttttttgtgctggcgtcaattccgccaaggatttttgaaacttacttgaccaaaataacggatcataaccaaacccattgtcaccacggggggcaatcagaatacggccggctaactcaccgttaacgacaagtttctcaccactgggtttaagggcaaccagggtcgtatgaaaagtcgcggtccgctccgcttcaggaacgccaccaaggttggctaacaacttggcattattcgcagcatcatcatgatcaccagcataccgtgccgagaacactcccggatcgccgtgcaacgccttgaccatcaagccggaatcatccgcaattgccggtaatccggttgcttcgaccacaaccgtcgcctttttagtggcattttcttcaaacgtgataccgttctccttaatttcaggaatatttggaaaatcagccaacgttttgatagtaatatcatacggtgccaacatcgcgctaaactcgcgcgccttattggcattgttagtcgcaatgatcaatgtttgtggtttagtcattcgcttcactccctaaatcaatatgttgtgcgtgaaagtccggttggcccaaccagttccgcgcgattgcttcgaattgatcagccgcccccgtcgtgtagtactcatccggataacgcttagtagaacgatcgttagcaatatccaagtaatcgagtaccgccgagacatcgttcaccgtttcggcaccagaatcaatcaaggtcaccccaggccccatcacattttgaataagtggccgcaataatggatagtgtgtgcagcccaaaacaagcgtatcaacgtcttgtttttttagttgtttcaacgtttccgcaaccacccgcttggcaaccgttgattgatactcattcgattcaaccaacggcacaaactttgggcacgcctgcgaaacgaccgtcgcagtaggatctttggttaagatagcatctcgataagcattactacgaatcgtcccctcagtcgcaatcacaccgattcgattacgatgagaagcttttaacgcagcccgcgaaccaggcgcaatcaccccaataacgggaattgacaactgctgccgcaacgccggcaatgccgctgcggtcgcagtattacaagctatcacgagcattttgatctgctttgctattaagaaatccgccatctgaaaagaaaaagttcgcacttgttcagctggtcgcggaccgtatggcaaacgtgcctgatcaccaataaaataaactgtttcgcgcgggagttgtttcaaagcttgcttgacgacagtcaacccgccaacccccgaatccatgaagccaattgcatgttcatttgccattttaaaatctccgttcactgaattctgaaactttattatggtcttttttgaaattgatttcaagccagaccaattgcgacgaaattgtaaagtttccgttgataaattgaaaaaaaccgacacattagtggaaacggggtataataatgattatacagtggctagagtaccacgattttttgcatggaaaggaattatcatgacgaacgacttttattctcaatttgcgggcaactcgatcaaagcttccatcctcagtgtggaaatcttgcgagatgccttaataccaaagttattgggtgatgacagtagtggcatcctttactgggcgggtaaagacttggcacgccagtttcctgtcgctagtgatgatgatcttgttaccttttttgagcaaaccggctggggtcaccttgtcgtgattacaacgacggatgatctaatcacgtatgaattgactggtgagccggtcgctcggcgtagcgccacgatcaaatcaccagactttatgcttgaaactggctttctagctgagcagtcagcgctccgcaccaactgtgtgagtgaagctaaaattacgtttcaaaatcgcatgcgactgcgcatctcagttacgattgatcacaatcaaccaatcgtcaatcacgatcccgcaacaccaatcgaaatcgtgcggcctcaagttgaacttgatgacgtacaacctgaagaagcacagtaaaaaggacggccacgtggtcgcccttttttgcaacgttaaatagttttccttatatagtcattattaacggttgtccccggtcttaaaaaagagcgcaaaaaaacgcgccgttcacttaagaaggcgcgttcgctagcgaaccattaatgaaataatggcccagcttattatagatattgagctaaagtttgttggatctgttccttggaatggtagccaactaaggtatcaaccacttcgccatccttcttaactaataaggttggaatgctcatgataccaaagttgctggccgtttcagggttggcgtcgacatccatcttattgaacgtcaccttgtcacccatctcgtcagctaattgttcgaccactggtgactgcatccggcaaggaccacaccatgtcgcccagaagtcagttaacgttactcctgaagccgtatccgttgtaaaagttttatcagtagttgctgcgaccattataatcggcctcctttaagctttatctgttactaatagtaagtataccagtaaccgggtggaacacaaacaatttgcctgcaatcaaagcgccgatatcgtgcacagccatgaattcgcgtcatcactgatctgcacctggcactcgtcactggttatttgaactgcacctcagtcgcaccattgccgccatgatttggcacagcaaagtgaaacgacttgacttgccgattagacttgagatagttggtaatgccttctcgtagagcaccagttcccttcccgtgtacgattgtgacggaaggatacccggccaacaacgcagcatcaatatagcgatcaacttgagtcatcgcgtcttcataacgcacaccccgcaggtccaagttcggcgaaacgtgactcgcgtgggcactctgaacagtagcacgcgcgcgttttggctcttctggcttaacgcgttccaagtcaacgtcactaatcttcatcttcaagatgccgagttggacttcccactcgtgtttacccatctgacgcatcaacacaccacgttgaccatacgatttgaccagcacgtcatcaccttcatgaaaatcatgttgggctttggcacgccgtaatacacggtttttcttgagcttaggctgttgctccaatgcattcaacgcgcccttcgcatcaatcaactcgttttctttgacagtcgccgtaccactcgctaattgtttcttacgcaaatcactaatgatagcatcggccttagtcttactttgctcaacaatggtgttcgcctgcactttggcatcttcgatcaactgatctttacgctgttgatacgcattgaattcgctcttcaactgccggtgcaatttttcagaatctgccacttgggttttcagatgcagttgttcatcttcaacctgtttgcgcttcgtcaccaaatccgcaatcattgcgttgaggtcttgactatccgtatccgtcaacgaccgagcttgatcaacaatcgcttgcgggatgcccaaccgctgtgcgatatcgagcgcattacttcgaccaggaatcccgaccaatagccggtacgtcggcttgagtgtttcttcgtcaaactccatactagcattgatcgtatcaggtcggttaaacccatacgccttaagttctgggtagtgagtcgtcgcaacgacttgggttcccttggccccaatggcatccagaattgcgattgccagtgccgcaccttcttgcggatcagtcccggcacccaattcatcaacgagtactaaactgtgagcgtcgatctgcgctaagaaactttcaatattttccatatgggatgagaacgtacttaaattctgttcgatcgactgttcatcaccaatatccgcaaagatctcattataaacgccaacgcgacttccggcttcaacaggaataaataatcctgactgggccatcaattgtagtaatcccagcgtcttcaacgtaatcgtcttcccaccagtgttaggccccgtaatgaccatcgcctgataatcagtacctaaactaatatcattggcaacgactttgcgaggatcaatcagggggtggcgtgcttgccgtagatagacttcatttttgggtgaaacggccggttcagtcgccttcatatcatgcgcataacgcgccttggcattgataaagtcgaaatgtccaagaatcgccgcattattaatgatttcgtcctggtaaggcgcaatcaagttggagagtgcctccaagatacgctgttcttcttgcttttccgcaacttgattttgccgtaaccggtcattcatcgccatgacagcctggggttcgataaagagcgtctgcccactcgctgattgatcatgcacgatgccaccaaaccgactacgattctcggccttgaccgggataacgtaacggtcgtttctaatcgtgatgattgggtcgcttaaatacttggcatcatggtcacgggtataatgacccatttggttacgaatctccgtttcagtacgacggatattgctccgaatccggctcagttctggtgacgcctcatccgtgatatgaccgtcaccttcaatggcagtagcgaggcgcttcgtcacatctggtaaagtaactaattctgcaacttcatcaaacaggtgtcgaatatcattctcaggggcatcttctagcaactcggcaaaaaagcgcgtgattgcgcgcgttgtccgtaacacccgcccaacttgcccgagttcactcccattcagggtcgcaccgatagctaaccgtttcatatgcggttttatatccgctaaacgagcgaccggaatgccaccctttaaacgatacacttctgccccatcgttggtttcatctaaggcccgttgaatatccgcaacgctggtcattgggtgtagttcattgagtgcttgttggcccgttgccgagactaagtatggtgctaattgttgttttacttgttggtactctaacgtattcaatactttggaattcactgatatccctccgaagttccaatgaattacgaaaagccgcaaaaaaacggacaatgcaattacttgtcggcatcatccgtttgcattttcaataattcagcttgtttgtcaacctgatctgaaatcgcattgaatgcgagcaacgtcgcaatctccgtatcagacaaatcgggggctaatttttttaattgtgccacttgctcattcatcatccgcgtcaccgtttgcatgtgacggtcagatgccgtgccaatgatcgtgtaagtacgaccatcaatttccgctttaaagcggcgcttgttagcagtcatcaacatcccgcttcctttcaataacaattaatattctagcatggttatcacaattatgcgacagttagaaccgtctcataatttctaaaaaagcccgcggacatgcgcccacgagcttaatctactttcgactattgcatgccaccgtcatcggctaagaaggtattcaaaacttgctcaaccatatcccattcgtcgtccgactcgatcagttgtaattcgccattgtcgccatcttcaggattaaagatgtaggcttgaatatcaacttcatcatcggccgcagcatcagctggatataataaaatataggagtgaccgaaatcttctgaatcaaacgtgaacaaaatattaaataaggtttcgttaccttcgtcatcaactaatgtgatcacatcattgtctttacgatcttggttttggctcatgttagttcctcgctattcttgtgtgagtttgccgtggcgatccaagtagttttgcaagattaaacttgcagctagcttgtcgatcacctttttgcgtttcttacgtgaggtgttagcttcttcaaccaacatccgttcagcttcaacggtcgtcagacgttcatcttcaaagtctaccggcaaatgaaaccgggctgtcagtaactcgccgtaatgttgcgccgcctcagcccgtggtcccaaggtattattcatattctttggtagccctaggacaaagcccccagcatccaattcttcaacgagttcagcaacccggtcgattccgaattcctcagcatcctcattgattcgaataatttcaacgccctgcgccgtccatccaaaagcatcactaatggcaacgccaacagttctggaacctacatctaaccccatcaacttcatgcatcaacatccttatctgcctttaagtaagacttgacaagttcctcgataatctcatcgcgctgatgcttccgaattaagttccgagcatcctttaagcgcgggatatacgccggatcaccggatagtaagtaacccacgatttgattaatcggattgtagcccttttcttgtaacgcttcataaactgtcgttaacgtgtcgtggacatccttaacgctgtcattatcgaagtcaaagtacattgttttgtctaatgaactcatatcaagcacctcccgctagtttccgcttctaatctattttactaaatgcccatatgaagtacaatcaatccactttgatgtaacacattcgtaataataacccggagaatgcagacgttttctgcaaatccatcccgatttacactgttttttcatatactgacatacccctgtttcgaatgttcgaatagttgaaattcaaaacaggcacaccctttgtaacccaatcttctacgagttaagccggtcacaaggtaccataacattaaaaaatcagtaccgttagaacggtctcgtcctaacagcactgatttaattgttattttgatagctttaacatagctaaccaacataaaaaacaggatgtgcaaccaaagcaatcagtcttattgttcggcaagccactcatgcgcagctttcagcgccgctggtagtccagcaggcttcttcccgccagcttgggctaaggttgggcggccaccgccgccaccaccaacttttggtgcaatggctttgatcaagtcaccagctttgatacctgccttgaccttgtcatcactaacagcaactaataagttgaccttttcgccaatgactgttccaagtaccagtacgtcagaatactgcttggtcttccaagtatcggccaattgacggagttgatccatgccagagacttcaatttgttgggcgatcaacgtcgtaccgttcacatcgtcaacttgatcaaagactgccccagcctgctgtttggctaagcgactttcgaggctggcccggttctgttgttccgctttgagatcggcttgtaactgactaaccttggctggcgtatcagctaacttcggtgccttgacttgagcagcaacttgcttcaaggtttgttcttcgccggcaagcagttcgaaagcttccttcgaagtaacggcttcaatccgccgcgttccagcgccaatccctgtttcggaaacaatcttaaatagccccaattcactactgttcttaacgtgggtcccaccatcgaattcgatagaataatcaccaattgaaacaacccgcacaattttgccatacttttcagtgaaaaccgcaattgcgcccatcttgtgaccagtttcttggtccgtttgaatagcactgactggtaacgctgcccagatcttatcattgacgatttgttcaactttagctaactcttcgtcagtcacttgaccaaagtgagtaaagtcaaaccgtaaataatcaggttctacaagtgaaccagcttgtttcgtatgttcaccgagaacgtcacgaagcgcctggtctaacaagtgggtggcggtatgattcttttcgactttgttgtggaatgccaagtcaacgttcagcgtataagtcgcgtcttttcgcattggtttcaacacttcaacggtgtgtaaatgctgcttgttgggtgcattttgtacgtcagtcactttagccaccatttcaccggcatcatctaagatcacaccacggtcggcaacctgaccacccatttcagcataaaacggtgtcttgctgaaaatcatctcagcttgaccactgtcgacgtgatcaaccagggtctcgtcaacaataatgtcgttcaaagtcccctgcacattcgttaattcgtcatatcccacgtattcacttggcgttttgatgtcgatcaagagactccgttggacgcccatggacttggcactgctacgtgcattgcgtgcgcggtcacgttgagccttcatttcaacttcaaaaccagcttcgtcgacatctaaatcttcgtcgccagcgtattccttagttagttcgaacgggaagccataagtgtcatataacttaaatgcatccttaccagctagtgtatcgtgaccagcctgcttggtttccgcgatcaagttatttaacagattcaacccatcattcaaggtctcattgaagcgactttcttctgaagccacgatcttttcgatatacgcactatttttgagcacgtcgggatagtgtgaagccatgatcttgccaacaatcggtactaattggtccaagaaagcttctttcaaacctaatttttgaccatgtaggattgcccgccgaatcaaccgccgaatgacatagccacgaccttcgttggaaggtaaggccccgtcactaatagcaaacgtaatggcccgagcgtgatcggcaatcactttgaaggacacatcgtcctgggcgttatcaccgtagtgcttgccatcacttaattcttccgtcttatgaataattgggaggaataggtcagtttcaaaattggttttcgcattttgaaagaccgaaacgacccgttctagccccatccccgtatcaatattcttacgcgggagtggttcgtaagtaccttcaggagtgtggttaaattgcgaaaagacaatgttccaaacttccaagtaacgttcattttcgccaccaggatagttttccgggtcatcatcagctaaattattgaaagcttcgccacgatcataaaaaatttctgaatcggggccagatgggccttgaccaatgtcccagaagttatcttcgactttaatgatgtggtctggtttcacgccagttgcttcccagaatttcacggcatccgtgtccttgggataaacagtcatgtataacttgtcaggatcccagccaaaccattttggtgaggtcaagagttcccaggcccaactgattgcttcttttttgaagtagtcaccaactgagaaattaccaagcatttcaaacaacgtgtggtgccgcgccgtccgcccaacattctcaatatcattcgtccgaatactcttctgtgaactcgtcatgcgggggttatccggcacaacggagccatcaaagtacttcttcatcgttgcaacaccggagttgatccataataacgttgggtcatccacgggaactagtgatgcactagggacaatcgtatgacctttttcatgaaaaaagtccaagtacatttgccgaatttcactactacttaattttttcatttaattctggcatcctctctatcattcttaatttaaggcaaaaaaacaccgttgctagcaaagacgctgttaacgcggtaccactctgcttgcaacgatgtgttcgtttacctcttaagctcattaacgctgagacacggactagtttgctagtcattacttctaggtagcatctaccccacaccgcactttttccagcaaccaaagtgtttcttgaccgatatgtgagatagatatgtccttactttgcaaagtatagaaaacttgcggcgacttgtcaatacaccactcagttattttgcattaatctatccggatgcacgtcaattaagacttacgatccttgcgttccttgcgggcagccgctcgttgttcgatgcggcggtccatccgcgccttatcgctgatctttttacgaatgcggcgtttgtaacccggcttgatctttttcttggactttttgacgtaaccaatcaaggttgggtccagtttttcctgttttggcccccgtttagcccgacgattacggtcatatgaatccacaatctcaccatcacgaatcgccttcggtttgaacttgatccccattgcttcaactgcactgaccttggcttcttcgcctgggctatataacgtaatcgcagtccccgccattccattccggccggtccggccaacacggtgaatgaagaattctaagtcattcggaatatcatcattgatgacgtgtgaaacaccttcaatatcaatcccacgggcagctagatcagtggcaacaacaaattgatacttcaattgttggacgtcgcgcataacccgctttcgttcacgtggttggatatctccatggatcattgcgaccgttaaaccttgttggcgcaaataatgggtcaactcttgaactcgttccttcgtgttagcaaaaatcaacacgagatacggttcaccaatcgtcagcaagcgataaataatactgtttttatcgtgactcttggtggaaatcagccagttatcaatagtcggactaatcacagattctactggaatttcttccataactggattgttcatgtacttgcgcaaaaatggcgttaatttttgtggcatcgtggctgagaacaccaacatttgtaaatcagcaggcattcggccagcaatctggtcaaccacgttcaaaaagcccaagtctagcgtcatatcggcttcatcaactactagctgagtcgcacgatgcacatcgagtgcctgggagcgcattaagtccagaatccgtcctggggtcccaataatcaactgtggttggtgccgatttagcttttcaatctgttcctgcttatcagtcccaccgacatagagtccaatgtgaatggctttcgggctgtgttggatcaactgtttagcagcagtctgaatctgataagctaattcacggctgggcgttgtgataactgcctgcacgtaacgttcatcagcattcagttgattgatcattggcagtaaaaacgtatgcgtcttaccactcccagttgctgactgaccgatgacgctgcggccagcagcaatcactggaatcaacttttcctgtaccgcagtcggtttgcggaaattgatgtcagtcagtgcctgcatcaagaacggctgcaatttaaaatcttcaaaacttgcggtcatatttaaacctctttctcataatggctagcgacttggtcgagttctcgcactaccgtttcaatttcttgttggtctttagccttggcaccgctcgctaatgcgtggcccccaccatcatggttcttggccacaccgttgattgacggtccctttgaacgtaaccgaatacggaagtcaccttccttttgttgaacaaaaatcgcccagcacttaaccgtatcaatacgcccaggtaatgggacaaccccagcagtactagcatcaccgattgcaaatgaatcgagaatcgcattcgttaaaataacgtaagctgcacccgaatccaactgtgtcagatgttcataaacgtaggccgacaaccgtgcgactggtaacgtgatggtatcttcaatacgattaacagcttcagcatccgcaccggcttccattaaggccgctgctgctcgcatggtactaggcttggtcgcagagtatagaaagcgaccggtgtccccaacgatgccggcatacaacaaccgagcggcgttagccgttagcgttaactccaccgcaaggggtgcgtaccaattataaatcatctcactcgtactggaagcatcaacgtcgacccactgtgggtcaccgaaagcgtcatcgtttgggtgatgatcgattttaacaattgtcttaccttgattccaaagttcaccatcaattcggggctgattagcggtatcaagaattaatactagtgcgtcttgatagtccgcttcggtaacctcatccatttgtcctaaccagtcaaaaccatggtactgttttccaggtgtcaatacccgcttcgcaggaaagctagctttaatgatagctgctaaccctaactggcttccgatggcgtctgggtcaggtcgctgatgacgatgaatgatgattgtttttgcttgtttaattaagtcaaaaattgctgtttggacggtcataaatgaaccttcttactctcataatttactggtggcgattaaactgtcacagtactccagtataccgaagaatccgcgtcgcgccaaataaattaattatcatttggataaagtggtaacgttaagttctcaaacgccagtggtgccaagccagttagcgtgatccctaacaggcggatgccagagttaaaatgatcatcgaccacctcttcaaaaatctcttcggcgtactgctcaaacaaggccgcgtcattaggtatgaattcaccgaacgttcgccgcttggtaattgtgacaaagtcaccgtaacgcaacttgagaacgagtgttttaccgtggcgctgatgcgattgcatgctagctgctaccaacttagcgatggccttcaagtgcgtattaacttccgtcgtcgattggagaaacggtccaaacgtccgctctttgccgattgatttccgttcacgtaaatactcgactggccgatcatcactgccgcgcactcgccggtataaaatatagcccaacttgccaaattgtttgattaggtctaattcagactgtgcgtataaatcctgtccagtcttgattcctaaatcgtgcattttaggtaccgtctttttaccgacaccccgaaatttctcgatgggttcacgtaataaaaatggttctgcatcctgtggtaatacgatcgtcacacccgctggttttcgataatctgatgctagtttggcaatgaatttgttgtaggagattcccgttgaacaagttaaatgtgtttgatgccaaatttcttgttgtaatcggtgcgccagttcgaccgcactatggatgtgtttcttattcgtagtcacatccaagtaagcctcatcaaaggcaattggctcaatcatctctgtatactcatggaaaatacgatgaatctgcgccgaaacttcgcggtacaacggaaagttgggcgtcttaaatactgctgttgggcagagttctaatgctttagcagctggcatcgccgagtgaacaccaaattggcgggcaacatagttagccgtcgtcacaacgcctcgcccacctgtctgccgaggatcatgcgcgatcactaacggctgcgtcttgtaggctggatgctcccgctcttcgatcgacgcataaaacgcgtccatgtccacatgaataattttccgactcgtatccacccgaataggcgcttcaacaattgactgtgccatccgccgcccctccaatccttagtactttcattatacacgaacatacgttcaaaagcgcgtttcaagaccaaaaaataagcaaaaaaaataagcggtcatcagtaatgatcgaccacttatggtgtaaacctattttgcttcagaatcagcattatcgtcggcggctgagcttgccgattcaacttcagaagtagcagctgattcagccgctgccccagattctggtgcaactgtcttagcttgtgcatcttcggctggagaaatcttagcaacagcgttcaaatcaaaaaccaagtagatgccatcacagtctaaagtaactgttttttcggtttcgttaacttcatcaacgaccccgtgcaagcgaccaattgtcgtaaccttgtcaccacgtttgattttgcttaacatttgttgatgttgttgttgttgtttccgttgtggacggatcatgaagaagtataagaatgcgaacatgaccacgataaacagaattgatgccatttgacccatttaatatcgctcctactctaattaaaagtttgactatctttaactttaacaaattacagtctgaaataccagtagcactaaaagtttttcgggtttttatcgttaaaaccgtacatttcaaagaagttctggcgaaactccagtaaattatcatccataatggcttgacgaacttgcttcattaagtgtaacaagaaatataagttatgataactcgtcaaacgcaaaccaaacgtctcgtccgccttaatcaaatgacgaatataagcacgcgtgaaattacgacaggtataacaatcacaattatcatctaacggggtgaaatcgtgagcgtaggccgcatttttgacaactaaacgcccatgggacgtcatgcaagtgccattacgggcaatccgagtcggtaagacacagtcaaacatatcgaccccacgaattgcaccgtcgatcaaggcatccgcagagccaactcccatcaagtaacggggtttattttctggcaatagtggcgtcgtgaagtctaaaacatgattcatctcagccttcgattcacccactgataagcccccaatcgagtagcctggaaagtccaagctaacaagatctttggcactctgttcacgcaagtctttaaagcccgcaccttgaacaatcccaaataagccttggtaatcagggtgttgatgaaccttcaacccccgctctgcccagcgacttgtccgggcaactgacttgctaacatagtcgtaactttcaaagaatggtgggcattcatccaaactcatcatgatatctgggccaagatcattttcgatttgaatagccttttcaggagataagaacatctttgagccattcagatgattcttaaagtggaccccttcttccgtaatatcacggtttttagccagggaaaagacttgaaacccacctgaatccgtcaagattccctttttccaattcataaactgatgtaacccgccagcttctttcacgatttgctcgcctggccgtaaccacagatggtacgtattcgataagataacacccgcacccatcgcgtctaattcttcgggtgccagtgacttaacactggcttgcgtcccaacgggcataaacatcggtgttggaaaggtcccgtgtggcgtaatcaattcgccaaggcgggctcctgtgtgtttttctttcttaattaatcggtatttaattgccggttccatatctgttcctccgtattaaaatgttgctaaactcaaataatgatagcacgaaatccagccgtgaaccagtcgcggcaattggcgtgggcacccacgtggctttagtcagtctgttaacaaagcgttcaaacgtcaaatagtcgcctcaagaatgcattttaacttcttgaagcgactattgacaatctttattatctccagagctaaaacgtcagcttgaaattagcgatacgcctcgtataatacggcattttaatattcaaccgtcatccgtttcaaaataagcgatctcgtttaaagccagttatactagtgaataaacatcgcatcgccaaaactgaagaagcgatacttttcatcaatcgcatgttgataagccttcaaaatcatatcacggcccgtaaaggcagccactaacatgaccaaggtcgacttcggtaaatgaaagttcgtgatgaacgcatcaacgactttccattgataaccaggtttgataaagatatccgtccaacccgaatccggcttgatttcaccatcaaacttactaccaatggtctctaacgtccggattgacgttgtcccggttgcaatgatgcgcccaccattttgccgtacttcattcaacgtcttagcagcatcttcgtccaatcgataaaattcactgtgcatcttatgatcatcgatattatcttcttcaactggccggaacgtccctagtccgacatgcagcgtcaagtaaaccaacttaatacccttgtcttgaactttttgtaagagttccttcgtccagtgtaaaccagctgttggcgcagctgccgagccattttccttggcataaacagtctgataacggtctggatcatcgagtttttctttaatatatggtggcaatggcgtttcacccaggctctccaaaatttccatgaagatcccatcgtaatggaactcgatcattcgaatgccatcttccttttcggccgttacggtcgccgtcaacttaccatcgccaaatgaaatcacggtaccgaccttggcacgcttggcaggtttcatgagtgtctcccattcatcaccttccgtattatgcaataataggacttcagcgtgaccaccagtttcaggtttaacaccatacaaacgagctggcataacgcgggaattattcataacgaccgcatcgcctggattgagttgatcaataatatcgtagaaatgcttatcttgcatttcgcccgtttggcgatccaattccaacaaccgtgaactatcccgttttttgattggtgtctgggcaatcagttcatgtggtaaatcataatcaaaatcttcaagtgttaaactcatgttgtgacctcttatctttatttattttctgggtatgggaatcccaaatgctgataacctttaattgtaacaacgcgtccacgttgtgttcgcttcaagaacccaatctggagtaagtacggttcgaccacttccgcgattgtatccgtttcttcaccaatattggccgcaatcgtagcaagcccgaccggacccccgtcataatactctagcatcgttcgtaagagcttattgtcagtctcatccaagccggcatcatctacgcgtaaatatgtcagtgatcgcgccacgatggcctcatcaatggcatcttgatccgccacttctgcaaaatcacgaattcgcttgaacaagcgattagcaatgcggggcgttccccgtgagcgacgcgcaatttcgtgggcacccgatggtttgatactcgtttgaaaaatatctgcagtccgcttaacgatatcttccaaatcagcaacttcatagtacgccatatgttcgacgattccaaatcggtcacgtaacggagctgacagcataccagctcgggtggtcgcgccaatcagcgtaaacggcggcagtggaaagtgtacgggatgggcggttggcccctgtccgaccacgatatcgacaaaaaaatcttccatggccgaatacaacatttcttcaacgattttcggtaaccggtgaatttcgtcaataaataagatatcacccggctccagttcattcaagagcgcaaccaaatcacctggcttttcgattgcagggccactggtcgtgcggatattgacctgcatctcgttggcgattaccatcgctagcgtggtcttccctaatcccggtggaccatacagcaaaacgtgatccaaggattcctcacgcttgcgggccgcttcaatatacactcctaattcgtgcttgacccgggcctgaccaatatactgggctaacgtttgcggacggagcgatttttctaatgacgcctcttcgtcatcggctttgtcaccggataataacttgtcatcgtccatttagttacctctcccatctacttcttcatcaatagtcgtagtccttcactcaacaaggtgttcgtatcggccccttgtgtctgactaaacgtctccaacttcttagtgaccttcttgacatccgctttcgaatagccaagagcttccagagccgccaacgcgtccgctaacgcgccatcaacagcaggagcatccacatcgagcgcagtttgaccagtcacatcaacgtttagatcgtttaatttacctttcaagtccagcacgatttgctgagctgtcttcttgcccacgccaggaaaactcgtcagataagtcgcattctcttgattgatggcttggatcagacctgcatggtcgttgttggccaaaatcgcgagggccgacttcggaccaattcccgaaaccccgagcaacttttcgaacaacgccttctcgtcagcatcaaaaaagccaaataggctcatgccattttcgctgacggcttgatggatatacatcttaactgctgttgggcccacctggtaacggtatggattagccgttagcactttataaccaatgccgctgacctcaatcaccacataaccgggggttacatcggtcacttgaccgagaaaatattcgtacaccgaaaaaactcctttaaataaaacgtatgtttgcttgctaaattgtaccacattttcacagtggcttaacactggtgcaccgataaaaaccaaattttaatgttaaatcaatttcacctcgattgacggatttcgttgcaagaaatgcttgccgccacgttaacgtcatgctatgctcaaagtcctagggaggtctcgctatgcaactcaaaccgtttaaagcggtgttaccaaccacaactggtcaaactaaaattcaaacagctgcgaccaattgggacagccaggatacaatgacgacaaccgaagccagctattactggtacgaactcacactcaacggtgttcaccagtggcgcttaattggcagctggccggtggatcaaaccgtgacgaccatggttcccggcacgatcaacacagtcctttacccacagcagcccgttatcgagatgttgattgacgactgggtcggtcattttgccccggtcgtcgaggtgacggataccgcgcacgtcacacatcgactctggcagattactgagtctgaggtcaataccgacatcacaacggccatggcacccgttatcccgcagaaaacgtggttgacaacggtcagcacgccactcgtcatgttagtctcaaccagtgaatggcaaaaattagtcactgcaccggtcattcccgaacaattaattgcgttagcgacacctcataattaaccagtcgtggctgttaattgtgaatttcgctatggcatacattcgtttgtgttccatctaacgttaaataggcttcttaggaatcaaagttaattcctaagaagcctattttaataccgatttactcaattaagattgtctgacacgtttgtgaagcccccaccagcaggcaatcagtatgctaatcacaccaccaataatactcgaccatatgccgatttttagtcctggtgtgtgatacgtcaaccgaatctggtgccggccggctgtcaacttggcccccacaaaccctttgttgacgacttgggtcctaacggtttgaccgtcaactcgtagctgccaaccagtcgaatacggaattgacgttgttaacacggttgctgtcttagtcagcgtggttcccgtaatctggttgttcgtcacttgttgatgcttcaacccactcgtctgtagttgccgcgtccgttgacgataagtcttcccaagcggtacagcgatcagtttagcggacttaaaatgcaaactacgaatgctcgtaaagttcaacgtaatcagcttacgcgcgtacttgctataccctaagttgattactgctgatgtccggggctcataatctgacatattcgtggtacccaactgactaaagctcgtcaagttatccgttgtctgagcagttaaagaatacccactagcgctcaaattgcccttcagaccatcgcgaacatcatctagataatcgactttggtatacggacgggccgtgaacacgttggtattttgactcgttgtcaaggcgtgcttgattgaggaacgccgataactgatgccatctagcacaagatagagttccgtatttcgatacttcttagggtgttgaatggtcaattggtacggtatctggtgcccctgcacatcactgaccatgctcgttaactcgtcggcattgttttcctgatttttctggactaacttttgattagctgcaatcaagttcaacacgcggtttgacggtgtcgtcaggccagttgccggcgtcaaactttctcgttgttccggcgttaatgtgatcgtatctgccggtaacttagtcaacgcgttgttcgacgctcccgttgcatgttgattgcggtaaataatcaccttgtccaacgtatccaaaacattcgtcgtatccgcttgaaccgtataagcgacgttttttccggtaacggttggcttgacagtcttaacaccactaacctgctgcgtagtgaccgcaccttgtaacaaggcttgctcgcggtcaactgcgttcaagcgattaaattggcgttgactaatctgatgctgctgtgtataaactaacggcaacgcattcttggattttaacaagatcgtgccggtatgattactcatgccataaataaacttgtccgcaaaaatcttcggttcgccagttttcatcttaacaacctcatatccggctggtaaggcttgtttcttcaactggtcctcacgtgcaaataaatatttaacacctaataagttatacatcgtcgtccgaccgtccaacgaaccgagtggcgagttcatcgcatactctgagttgcctaaggcctgactaaatgcccccacgtaaccattttgaactgaaaaatacgatccaaccgtgtgagttcctaacaccatcggcacatcactctcagccgaacgcatcgtatagtagttgggtgccaaagccgttcgataaaattggctagtcgtggttaaacttttttgcgcgccatcaaaataatttttgacccatttcattgccgcgccctgccgcaactgctcagtactattagaattagtattgatactcaaccagcccagtccgttattcgccaggttcagcgtgacaattcccagtaataacacataaaattgccgattggtcaattttaaggattgtttggccagcaggaccccaattaacgctaacaagataagatatgtcgcaatatcatgtttgcggatattgagatagaatccattgatcagccaaataatgacaagcagaccgccactaataccagccaaccattttaaatcagccgctgtcagagcagtgacttggtccataaatgccatcgtcgcataagcaaacacgagggttgccatcaacaaccatcgattagaaggtgttgaaaaaacgttgaatacggccgcaaattgaggcaacaaaatacccaacatcatcacgaccagtacccaattaagcacccaatagcgtctgaaatgacgtagtgtataaataattgcaataaagctaatgctactcagcccgagggtcacccagtattggacactgccaccattggtcaacagtcgattgggtaaattaacgtaataattgatgggataactcgtcaagccattcgcaaagttaaaactcgcacgcgttgccgtcaacatcgcgagcagcgtgggcactagtaagatgcctgccatcgtgacaccaagaccaactgccactagtaaccgccaaaataactgtccaaacgaccgcatcgttaaatggtcacgacgacgtgaccagaaacgcaccaaagcatagactaaaccgcccaatgcgagtaagtaagcaaaatagaagttactcaaaattacaacggcggtaatcagactgagtggtaaccaatgtcggcctcgtaagacccgttcaatcgcccaacacagtagcggaaaccaaatcattggtaacaagaaaaacgggtggtgcatcccaacatagaacgtatacgcggtaaacgtatacgtcaaagctccaatcaattgactgatacgtttgaacttgaactgccgactgaaacctagaaaagcaagtccaacgaagtacaatcgcagcaagatcaacgcttggtaggcccattccaaatgagcgcgcgaaacaaacgccactaaataattaaacggatcaccgaccacgtagtaggaaaaagtcgtcagttgatcggcccccaagccgagattccatgaccaactgaataattgttgtgggtggtgctgtaagatccgctgaaattccaataaaatcgggaagtgttgggcgatgccatccacttcccaaatcaatgtccggccggctaagaaaagcccactgtaagtaatcgtcgcaataaccacaaacatcgccgtataccagacgactagtggtatcttccgtactgtcttcaaatcaggtgcccctatcttgtaattacgtcgacaacgcaatccccatattttgccatctcaaacaatgtttctattttaccatgaacaatttcgtctcgtgatgttcagtttgaatcttaataaattcgtgattcacagctgtcccatcaacaactaacgccaatcccagttatctaaagtttcaatcttagtagtcgccggataactcccaaacaactgtactaaaggttgtaagccactcacagcattatcacgttgtaagttgatcgcagcgattgccgcttgatcatgacggttaggatcgagctcaaaaacagcaacttgctcatataaatttagcgtaatcaatttggcgtcccgcgcacttggatgcgcatttaattcccacagcgtcttgcgcccggccacgaacgtgggcgtggcctctggtaaatctgccaaaaaacaatatgccgaataaacctggcgataataaagtttggtcatatccaaaacaatcaactcccaatcatgttgagtggtccaagcacccgatacgcgctcaccactcattttaatcaatgatagctaactatttaaaccaattcaatctgaaattttacaactcaaattagtgtcacaaacgccacttccccaatcttaaagttgttttttagaccgcaatactggcgacaataaaagtgaggctgtgacataagtctctagaaacaaagcaggtctggaaaaatcttcgaatttttccagacctgcttttgatataatagaaaaccaaaaaagagcatcggtcgcacccgatactctacgaaattatcctcgaaaggacattcctaatatgcaagattattataacatgaatcaaaccactttgagtatcgccttggattaccaaccagaagagcatcattctgctcgttacatcaaccagcttgttgagagtttaaaactaaaatatgattaccagtttggccgtccgcgggaatataacctcggtgccatgttaaaactggtccttttagcgtacagctatggcattttcagcagtcgtaaaattgaacggtttgcccgtgaaaacaagccagctgggtggttaattgccgaccaaattccgtcctaccggacgatttgtcgctttagaatttctgatgaactggccactttgacaaccgatagcttatcacaactaactcaatatcttcgtcaaaatggcatgattgatgatgtttcatttattgatggaactaagatcctagccgacgccaacaagtatagttttgtttggaagaagaatacgatacgatttgacaagatgaatcgcgagaaactcgttgacctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttggacaaacgacgtgataaaatgcgtgaacaccaagcacaacaagcaatctatggtcagcgtaacagttactctaagacggactatgatgatgctaccttcatgcgggtcaaggaagatccgatgcaaaacggtcaattaaaacctgcctacaacgttcaaatcgccacgagtaatcagttcattacgggatatcggcttttcccaaatccaaccgacacacgaaccttacaatcgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaatttccgcggcactaacaccaaaaggatatcttaaaaggatttccgtgaacgaaaattgggaatatttcaaatcgaaacaacgagaattactttcatctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaatattatgaaactggtcacggtagggaccaactttaaaaatcaaaggcgtaagcgaatgggacgagaaaccgaattttggtttctcgtcccattcgcttnnnnnnnnnnnctaagaataatttggctactgagcattgtcacccagcccctccggtcgggaaaccgctcgaatggctgatgaacgaccacctaatttggtacaattagtcgctgactattttgatgctggaagtttaaacaaagcgctaggtgcattaagcactctgtcaagagattaaatcctactacaccgattcaggattagtgagccatctcaatattatttttagtctgacagttgattgacaaaattaccgtttatgaaaagcaacgaccaattcatcaaaagttgggtacctcaccgtctgccattcgaatactatcccgactggaaggcgtttttgacaatgcccagtggtgaaagttcacttagcaagcgttctgtgcttggttagtgaaaggccagtatttgagacgtggtttttcggctcaaatctgtgcccaccacgttccggcaattggcagaaatgcctggaagtcggtgtaaggcgcacacaccaagcaagtctacgctagtccgaactttttccagcggtcttaagctggctgcttttgaacttaagaaatggcacgttttaatcataattcatgaaatatttacttgcacaatgcggatcgattacgaatcatactaaagtaacgagtacgccgccaataatcactttaatcacgtgcttcatgactatcctgaattcgtttgaacatccgttccatgtctgaattcgtgaagtgtaccgtcaccgggcggccatgtgggcaattgaacggattctcgcaggtcggtaacttggctaataacgcgcgggcctgctgatcatccaaatggtgattggccttgattgcccgtttacaggacatcatgatagctgacttttcccgaaattgggcgaccgtcaacttatcatcctgtaagagccaatcaatcatttcacgaatcgtatcttcttcttgcccagctttgaaccaggtcggatgggcatgaacaatgaagctgttgccgccgaatgattccagatgaatccctaattctgctagtaacggcaatttttccttgatctttaaaacatcgctcgtcgggtaatctaaaataatcggaaccaataaattttgttgatccgcactaacctcacctatcgcttggcgataatattcatagttgattcgctcctgggccgcatgctgatccaaaatgtacataccatcatccgcctcagctaacagataagtcccgtgcatctgaccaagatagcgtaactgtggaaaacgttccgtatccggcgcttcactagtcggcgcgcttgcagccgtgctggtttctaacggttcagcagtttcaccaaagggtaaagcgcctgattctgactggtaacgctggtcaaatgcttgaactggagtagctgtcagttcgtcgcgatggctaatcataatcggcgggttggcagaacttgccgctgattctgacggaacaaccgcactaactgctgcacggtttaccgctgatggctgtgctgaagtagtacttaccatggtcgttgccgagctgggctgcatggttgccgctgccagcgaggctgcaaactgctcagtcgatgccggcgttgtcttatccgctacttgatactgtgacgaaacggcgttcaaatccatcgccagctggtctgtatttagatgttcacgccgatggctgccaagattggtcaatgctgacggaatcaagttcacatccactaactggtccgtaatcgtggtgctgaccagtttggctaattctggttccttactcaaacggacttcttgtttcgtgggatgaacattgacgtccaccaataaaggatccattgttaaagcgatcaccgcgattggataacggccgaccatcaacttagaaccgtaacctttgatgacggctttggtcaattgctggttcttgatagcacgaccattaatcagaacagtaatatactggcgactggcccgcgtcagctcaggtaaagccacaaagccactcaatttaaaatcagtggtcgatccttgaatggcaaccatcttgcgcgcattttggacaccgtaaataccagcaatgacttgttgtaagtcaccgcgaccagccgtttttaatagctctttcgcattatgaactaaccgaaatgccaccgctggatagctaagtgcgatgcggttaaccacgtctaaaatattcgctaattccgtttggggggacttcaaatattttagtcgcgcaggtgtattaaaaaacaaatcggtgacggtaatgtccgtcccttgccgcaacggagcgggcgattgttgtaatagcttaccgccgcgataatgaatactcgtcccagtggcgccggtactcgtattcatcaccacgtccgctactgacgcaatacttggcaacgcctcaccgcgaaaacctaaagaatggacgcgaaacaaatcttcacgtgatgtgatcttactcgtcgcatgccgtttaaaagcggtcaggacttcagcgtcatcaataccgtcaccgtcatcgataacccgaattgactgaacacccgactcttgcaccaaaatatcaacctgcgtcgcgtgcgcatcaacagcattttcaaccagttctttaacgaccgaggcgggccgctccacaacttcgccggcagcaatctggtcggccagcacagaagataactcatgaatttttcccatttccatcggtcctttcacataaaataattaagctcgtgtcctgcacgaacattttcgattaccacaactagcaataactgactagtgtcgacctacctgtccgtcagacgcaccaatagcccatcataacagcttattgcgctcatttatgatgagttaaaatgcgcctacttgtctaatttttgttgccatttatacagctggttcattacatccatcggagtcatcgccatcaagttcaacgtcttcagctgttgtaaaaccttttcacccttcgcatccgtcaccgccggctcagcaaataacgacagctgttcatcaccggcttcagcgaccggagcttcggcaaccggggtctccgattctactggctgtgactcatcggcggcctcaaccggcattgaagccgctgtcgtcgataccgtactcgtttgattttccaaactcgttaaaatcttattggcccgttccaataaactcgttggcatcccagccaacttggcaacgtgcaccccgtaggacttatcggcggccccgggctcaactttatgcaagaagacgagctcgccatcctgttcagtcgcacccacatgcacgtttcgtaacccggataattcttgatctaacgcggtcaactcatgataatgcgtcgagaacagtgtcttggcatgaatatggttatgcacaaactcaataattgcttgggcaagcgccatgccatcgtaagtcgccgtcccccggccaatctcgtcaaacaacactagactattggctgtcgcatgttgcaaggcattattggcttcctgcatctccaccataaacgtactttgaccggaaattaagtcatccgtggcaccgatacgtgtaaaaatttggtcaaaaattggaagttgcgctgatttagccggtacaaaacaaccaatttgcgccatgatgaccgtcaatgctaattgacgcatgtacgtacttttaccggacatgttaggaccagtaatcaaaaggaccgtctcatcaggtgacattgtcacgttatttgggacgtaactctggttacccatcactttttcaacgaccggatgacgaccatcaacgatcttcaaatcatgtgatttagttaatttcggtcgaacaaagtggtaatcttcactaacgacggcgaaactttgcaagacatcaattgctgcgaccgccttcgccaatgtttgtagccgctgaattgcctttttaaccgtttcacgaacctttgtgaagagttgatactcaagatccgtagaatggctctcagcttctaaaatcaggctttcatgcgatttcagttcaggagtactaaagcgttcagcattcgttaacgtttgcttacgttcatagcggtccttcggtaattgggccaagttggccttcgtgacttcaatataatagccgaaaacccggttaaaccctatcttaagattcttgataccggttgtcgcccgttcctgggcttccaactcagcaatccattttttcccattattcatagcatcccgatattgatcgagttgctcgttataaccatccttgatcacaccaccgtccgttactgacaaaggcgcgtcttcaacgattgccgcgtcaatcaaatccgcaacgtcttcgactggatccagctgattaacttcatcattaaatacctgcgtatctaattccgataagatataccgaatctttggaatctgacgcaaggatgtcttgagttgcactaagtcacgcccattcacgctaccaaaagccacccggccagctaaacgctccaagtcataaactttagtcaactcttcttgtaagttactacgttcaaaataatgatctaataacgtcgcaaccttattttgacgcgtttcaatatcggccttcacaatcaatggccggtcgatccactgctttaatagtcgtccgcccatcgccgtcttagtttcatctaatagccacaggagagttccttgctttttaccagttcggatggacttcattaattccagattatacttggaattatgatcgagtttcaggaagtatgacggctcataagcgatcgccttttgtaagtgcgcgaggctccgcttttgagtcaccgtaatatacatcaataaccgttccacgacctgttgttccaaatcgaccgtcaagtcctgagtcaagtagctcaattcagcctggggggtgacgttattctgttctgaaattagaattcctagcgtcttaatttgatcgcgcaaatcgctagcaacagagtcgtcgaccacaatttctttagtttgcaagctggtcaactcgttaattagggtatcgttagtcgttaagacactcgtttttagttccccagtcgacaagtcggcgtacgcaaaaccatattgttgatcacgctgaatcagcgcagtcaagtaattgttcgtcttagcttgttccgcgccccgttccaacgtcgtaccaggtgtcacgagctgaatcacttcgcgtttgaccatgcccttggctaatttgggatcttccatctgttcacaaatagcgactttgtaacctttatctactaaaatatcaatataattttgcacggctcgatggggaaccccacacatcggtatggggttttccgccgaatgattccgcgtcgttaaggtcaactctaataactgagcacctttaatcgcgtcatcaaaaaacatttcataaaaatcaccaagtcggtaaaataaaaacgcatcgggatattgatttttaactgcaaaatattgacgcatcatcggtgtatcttttgttttctgtggcacgcttaatcctactttctatcgtaaatcttagtcatcaaaatatgggtggtccggattaatcaaaatccgggcaatctttttcgcccgaccactctgaccatcaacgtcgatcacacaacccgacaacactgccggactatcctcttgcacgttgaaacgggtcggcatttgttccaagaaacgctgaataacattctcacgggtcattcctaaaataccattatacggacccgtaaaaccaacgtcacttaaaaaggccgtcccatttggcaatacgcgttcatcactcgtctgcacatgggtatgggtgccaactaccgcactcacctgaccatccaaataccacgccatggcttctttttcacttgtcgtttcagcgtgaaagtcgatgaagatgttaggtgtctcttcccgcaattgctcgaccaatggttggacagtcgtaaaaggatccgctaaattttgccccataaagacgtttccttgaagattaatcacggccaacttcaccgtattgaccttcacgatcgtataaccaacccccggagtcgtcgctggcggaaaattcaacggtcgaatcaacttcttagcaccattaataaaatcaaaaatttcattattatcccaggtgtggttgcccatcgtaatgacatcagcccccgcagtcaagatgtccttatacacttcctgattaatgccgcggccgcgggtggcattttccccattaacaatagtaacttgtggcttgtagcgccgttttaacttaggtaggtacgtggtgaccgccgtttggccgacattgcccatgacatccccaacaaatagaattcgcatagattgctcccttgttttaacgttataccaattattttagcattatttagccttgaaaacgtgattgaattctgctggcaactaaaaaaatgagcttaggtcaagacctaaactcatttcccggttatttagcgtaatccactgctcgaacttcccgaataaccgtaaccttaatatgaccgggatattcaagttcattttcaatctgctttttgacatcgtgcgccaaaaccgttgcctgtaaatcagaaatctcgtttggcttaacgatgactcgaatttcacgaccagcttgaatcgcatagctcttcttgacgccatcctcattattagcgatcgcttccagcttctcgagccgatgaatataattctccagcgactcactccgagcacctggccgggcggctgaaattgaatcagacgtcgcaaccaacaccgcgataatcgacttagcttccacatcaccatgatgggaggcaatcgtgttaatcacgacggggctctctttgtacttcgttgttaattccacgccaatttcaacgtgggaaccttcgacctcatgatcgacggccttaccaatatcgtgtaataatcctgcgcgtttcgcgagtgtaacatcttcaccaagttcagcggctaaaacgcccgctaacttcgcaacttcaattgagtgattcaaaacattttgaccataactggtccgataattcagccgaccaacaagcttgatcaagtcaggatgcatcccgtgcaatcctaaatcaaagacagcttgttcaccagtttcacggatcttttcgtccatttccttacgcgctttttcaaccatttcttcaattcgagctggatgaatccgcccatcttgaatcagcttttcaagcgcgatctttgcgatttcacgacgaatcggatcgtaaccacttaaaacgacggcttctggcgtgtcatcaataattaaatcaattcccgtcagcgtttccaacgttcggatgttacgaccttcccgaccaataatccggcctttcatgtcgtcattcggcaaagaaacgaccgaaaccgtggtttcagaaaccatatcggcagcactttgctgaatcgcttggacaattaagtttttggcttctttttcagactgcgctttcacttcgtccgtattttctttaattaacacggcccgttcatgcgttaattgttcgcgcgtttgggtcaaaatctgatcgcgagcttgttcttgcgacaaggcggcgacccgttctaactcagcttgacgttgcgtgattagtgaagctgcactttgttgctgttgttcaacgcgtttttgctcattggcaatcttatcttcttttttacctaaagcatcctcgcgcttttcaaaagtattctctttgtgatctaaagtttcttcacgttgaagcaaccggtcttcttgcttttgaacttcattccgacgttgctttaactccgtttcaacttcagcccggtagcgatgactctcttccttagcttcaaggactttttctttcttatgagtctccgctgcccgtttggcctcagaaataataccttcggctgtgttcctggcaacgtccaattctttttcatggacgttcttgcgtacatagtaaccaatcccataaccgacaacaattgcgatgactgcgaggattataccgaaaacattcatgtttccacctccgcaccaccaaaatccagttaacataaaatcaactacaaattttcagatgttatattttgattatttacacacttgttattctaatgttagaaacgaatagtgtcaacttaaagtcttatggcaaccgctctctgcaggctacttttgtcgtgcaaacaagctaagtatgtacaaaaaacgcccaaaataaatattttgggcgttgcataacaaactgtctatttttcggttggttggtcgccgagatcgagagcagtttccgctggtgtcgctttagtggacttactttgacccttactgccattcttagcagttcccttatccttagcttctttggcctgatcatcagtttcagacgtttcttcaccagttgcatccataccatatgcatcacgaaccttttggcgaatctccgtcatgacatcaggatgctcgtccaaatacttcttggcattttcacggccttgaccaatgcgatcgtcaccatatgaataccaagaaccactcttcttaacaatatccttttcagcagccatatcaacaatttcaccagtttgtgagataccttgaccatacatgatatccacttcggcacgcttaaatggcggtgcaaccttgttcttaacgactttgatccggacacggttaccaataatattggttccttccttgatctgttctgcccgccgtacttccaaacgaatcgtggcgtaaaatttcaaggcccgaccaccaggagtcgtttcaggattaccaaacatcacaccaactttttcacgaatttgattgataaataacgcgattgtcttggttttgttcaatgtccctgataacttccggagcgcttgtgacatcagccgcgcttgtaacccaacgtgtgcgtcacccatttcaccttcaatttcggcacgtggcactaaggccgccaccgagtcaacaactaaaatatcgaccgcaccactggaaactaaggcatctgcaatttcaagcccttgttcaccagtatctggttgcgaaagtaacaggtcatcaatgttgacccctaggtgttccgcataaacggggtctagtgcgttttcagcatcgatataggccgccgtaccaccctgcttttgaacttcagcaaccgcatgtagtgccacggtcgttttacctgaactttcaggaccgtagatttccacgatccgaccacgtgggtagccgccgacacccaacgcgtcatctaaggccaacgatccacttgaaatcgttgaaatagtcgtctgggcagcgtcacccatccgcataatcgcccctttaccgaaattcttttcgatctttttcagggcagtatctagtgctgctttccgtgcatcagccaaattatttcctcctttggtgctcgtttctaactcttaatatcatagctgttcaaagttagaattgcaagcaaaaagcgaacaaaagttcgtattatttttttaagtccgtatcttcattcaatgcatgtctcaataggtctaacccggccatcacactgcgttcccgaatttgttgtcgattaccagcaaaatggtactgcttggccttcacgggtcgatcacggtaagcaagaccaatccataccgttccagccggttgaccttccaaggttcctggaccggcaacgcctgtaaaactgataccaacatcagtatttagctgctgcttagcaccactcgccatggccttagcggtcgcttctgaaaccacgccctctgcgtcaataattgcttgtggaacgttcactagctgatgtttggcctcattcgcatacgttacaaagccgcccggaaagattgcggagaccccggacacactgccgatggtactctgaaacagcccagctgttaagctttcagcggctgtaatactcagcttagccgcaatcatttgattaataacagtagtaactaacgagttatcgtctccataaccgtaaaagtacggcccaatggtagccttgatctggtggtcaactttgtcgatcattccccttgcagccgtttccgtcatagcttgggcacttaatctgagggtaacctcgttagtcttggcatagggtgcaatcgtaaccgcctgctgttcatcaatcaagggttgcaaccgggtcgccaattcagactcactgatgccataaaaacgcatcactcgcgaatagatttgggcttgttccccatatgcagctgccaatttcggttttgcctcagaatcaaacattacggctaactcacggggtggacctggcaataacaagaaatcagcactattttctgactgataaaacgcaccaacagccattccgttatgattagtcaacggttgcgcgcctgccggatacaatgcctgtaatcggttgttggccgtcattactttgtcattagtggcaaaccaggccgtaattttttgcattgctgcctgatcttcaaccaaggcaacattcaaataatgcgcgagcgtctgcttcgtcaagtcatccttggtcggccccaaaccacccgttaaaataactaagtcattccgctgggccgcaatttcaatgacggtcgacaaacgttgccgattatcaccaaccaccgtttgataatagctatcaattcctaattcggccaatccacgtgcgatgtacgtactgttcgtgttcgtaatctgacccagtaaaatctcggtaccaaccgcgattatttctgcttgcatgccatatatgcctccccgtaatcctatcgattacactcagtgtgggcgcgatgattatcgtcctacattaagtatatacgaaaatgacgatcgaccccattaaaaagattagcattttcaaataccttcatttgacataacctgccaacgcgactcatcgttaaaattatcgactgacaggagtcatgattaattaataagggcaacacgttaatggtatacaaaaacgtctcaccgaatgcaagactcggtgagacgctcatgattaattttatttgaagccatctgcaaacacgtcacgattctgaacaaaataatcaatgccagaataaataacgaagaataagcagatatataacataattgccgcaaatggaatgtggattgccgcaaataagacattgttcagcagcaggaagatgatggcaatcatttgtgtcgttgtcttaatcttcccgggcatagcagcagccatcactttaccattattttcaacaatcaataatcgtaaccccgttaccgcgagttcacgacacatgataatggcaacgacccaatcaggggccgcatttaaccgaactaagatgatgaacgcggtcattactaacatcttatctgccagtggatccgcaaacttcccaaaattcgtaaccaagtgttgaccccgggcaatcttgccgtccgctaagtcagttaatgacgcaaccgcaaaaatgacagttgcaaccacttgggtgactggaattgttgttccagcccacacaacctgtccccaactaaggggtaacaccataataagaatgaaaactggaatcagaataatccgaaacaccgttaatttattaggtaaattcaaagtacccgcctcctccgcaacgttatttgatggtcaaggtaatcgtccgaacttgtgacgtactgttcttcggattaaaattgaacgccttaccattgattgttacggtcgtggcagttgcgttcccaaactggaacttaaccgtcgtagcattacttggtaacgttaatgtatgtgagccatccgcctttagcgttccttgccaagtctgagtaccgttagtcgtaacggaagtccaagcagccttagtagacttgatgaccactttgttcttatccgcaccatttgtcaaagtataagccgtatcgctactgccgttagccttgattgtttgttccttggcagaagacgctttagaactagactttgctgatgaactagctttcgacgaactcgattgcttcttagaactcgaaacttgtacagaagaactgtccgcactcgtgctagagcttgaaccagcgtgcgtgcgaaccgccataaaccaaataaataacaaaatcaaaaccacaatggcagtgacgatgatcgttggtaaatagttacgcacgcggctcgctggtgaagcaggttgttcgcgactagcaacccgggtaggttgaacttcatcaacattttcaacgatggtttcagtatgaacactcggtaattggtctcgatattcttctaacaacgcgttaccatctaaatcgactgtttccgcatattgcttaacaaacgcccgaacgtaaaaatcaccgggaagtttatcgaactgttcatcttcgattgcaatcaaatagcgtttctgaatcttggtgatttgttgcaaatcatcaattgtgaggcctttcgctgtccgggcagcctttaagcgcgccccaatcgttgttgtttcttcgttattttcactcattgactttttctccaccctaagtctattttcaaaatcttacggttaatagtatatcacagcaactaaatttagcagccccatgaccattaaatttcagatttccttaactctttgcttgtggtcgaatctggtattcactgattgcctgagaagtcaataattgttcagcaaccgtctgcaagtctgcaagggtcaactgatcaattatacccggttcatcaaagattgtcgccgtcccgaatagccgttgatcataccggttcgcgattgcctccaaggagttcgccatgaagacgacccgcccaatcatttccttcttgactaatgcgagtgctgcttcctgaccaactacagccgtccgccagttttctagcacatcaatgatggctgcatcaaactgggctggatcatccgtttcaccactaaaagtgacaaaattaaatccagactgtaattcgaaatcataaccaaacgtatcatcgatgataccctgatcatataatcgcaaataatctgctgacgtatcgccaaacaataattctaataaaacgttaaccgctgcacggtacttcaaagcagcagcccccgcttcaatcggcagcaagcctttgacaccaacgattgatttggcccgattgactggcatatcaatcgtccgataaggaataatgtcatgtccatccgttgcggtttcaggaatcttacgttcaatcggttgaaaggcagcaaattttttagttgcttgattagtcgtaatccaccctaacacttcgtctggatcaaaattaccaaccacaaataacgtcatgttctcaggatgatagaacgtccgataagcggcgtacaagtcatcagccgttatcttagcaatcgactcagtcgtccccgcaatatcatattgtagtgggtggttcggatatagattaccaatcattccgaaatacaggcgccaacttggatcatcatcgtacatctcaatctcttgcccaataatgcccttctccttgtcaactgtcgctggcgtaaaatacggatcttgaacaaaatctaagagggtcatgaggttgtcctgcaggtgccgggtagctgagaacaaatagctcgtcttcgtgaagctagtgaaggcgttcgcgctcgccccgtactgaccaaaaatttgaaacgcatcatggtcagccttctcaaacattttatgttccagaaagtgggcaattccatctgggaagcgttgcatttcagtacttccggctggaacaaaggtattgtcgatcgagccatagttcgttgtaaacgttgcgtacgttttgtgataaccggccttaggtaacaacgtcaccgtcagcccattatccaactgagcttgataacaactttcattaaattgatcatatttttttactttcatgcggttaccccactcaagaagaacccattattaagggtcaccatcttcgcgactgcaatgatctgttcacgcgtcacactttgaatctgccgtagccattcagtatccgtaacgcgttgttgcgttaaatcatcgatcaaggcttgcacagcgaatgtccgttgactatccaaactggactcaaaatcgttgatcaagcccagcttcagctgttcaactaaatcatccgtaaaatcaccggcttgaatcgccgttaattgggccgcaataattgctaacacttggtcatgatttttgccatcaatcccagcttgcaccttaagcaccccacggaaagtatccaatgagctgctggcatagtaagccagactcgccttttcacgtacattcataaacaatttagacagcggtgacccaccaaatagttcgttgaaaaccaaggccgcgtaataatgattgccacgataaaagactggcaaatcataacctaaatttagctttgcttggctgagtgcctgttgttcactcacttcgacgtactggtttgtattatgatgttgataaaatggccgtgggcgccccgtcagtcgatcctcaaaaccagcttgttgccactgagctaaaacggccgcctcatcaacgtcacccgtcacgataatatcgatttgatcattttggatcatcatttgataatagtcgtacaaaccttccgcagtgagggctgccaaatcactcgccgtaccgtaacttggcacttgttgcgcaggttcgtccgcaaacaacgccgtatttaactgctgtgcagcataatattgcttatcatcagcgaccgacataatcgccgcttccaaattctttttttggcggtcaaacgtcgcttgatcaaactgaccgtccgccactagcggctgtaaaacgacttgttgtaaaaactggatggcctgatttgtcagtggctgatccgttgccaaataccgttcattcgcaacggtgatggctaattgcaagttatgcgttggtcccttacgactaacacccgcaccaaacgcagcaccatacataacagccaatgcgttggctaacgctcgctgatctggataatcacgagaacttgtttctaataaattcgatagtagcgaccgctgagtaattgtttcacgtgcaagcggtgcccgaaaattgataataatctggttggttttaaattgatgactctgaaccgtcgtcaattggaccccttttgctaactgagtttgcaacatgtttcctccttgcatatgtaataaataataagcgaaaggccggattgacgcaactttccgtcctattgttttttttattttcagattatggtcgccaaaatgattattttcacgattaaattaaattctcgtgagtggcaattaacattgccaagtcgcgatttgtctgctattcttttcattattgataaaattaaggagcggttaatgtgaaagtaattaaatttggtggcagttcccttgctagtagtcagcaactgcaaaaagtcctcgcgatcgttgaggctgatcaaaaacgtaaatatgtgattgtatcggcacctggtaaacggttcgatggcgacaccaaagtcactgatttacttattcaatatgcccgtcaaacgatccatcatcaagatacgcaagccgttaccgcagctatcattgaccgttatgcagaaatcggtcacgggtttaacgttcccgaagcacaattgactccgatttttgaaacaattcgcaacttaccaaaacaatcatacgccgacaacacctacttgatggcagctttcaaagcgcacggcgaacgtctcaatgcgcaactggtcgccgctgtttttcaacaaagcggcctcaacgctcgctaccttgaccctaaagatgcgggaatggtcgttacggacgttcctgatgatgctcagattatcaagagtagttatgaccagctcgctaagtgggccaacagcgaacaaatcctagttatccccggatttttcgcctacaatcgtaacggccaaatttgtaccttttcacgcggtggctccgacattactggcgcaatcatcgctcggggtgtccatgctgaacgttatgaaaactttaccgatgtcgatgcaatttacgcggtcaatcctagtttggtcgcaaaaccagcggccattagtgaaatgacgtttactgagatgcgcgaactttcttacgctggcttttctgtctttcacgacgaagcgttgattccagcaatcgaaggcaacattaccgtcaacgtcaagaatacgaaccatcccgaggccccgggaactttgattcagtcaactcgcgaacccaatccccactacccggtgactgggattgccagttcttctagtttttgttcactatacttacgtaagtatctgctcaacaaagaagttgggctgggccgtaaaattctaacgattttagaaaatcatcatattagttatgaacacatgccatctgggatcgatgatttgaccatcatctttgatgaacatcagttgacgcccgaattagagaaaacgttagttgcagaaatctcagcggccatcaatcccgatgaaatttactttacgcacgactactcaatcttaatgctcgttggcgaaaacatgcgcaaccgcgtcggcatcatgtcacgtgccgccaccgcattagccaacgacaatattaaattaatcatggtcaatcaaggcgcctccgaaatttctattatgttcggtgtacacgacaatgatgccgatcaagccgttattgcgttatataaagaatttttcgattaacccatacgtccgactagtcaactagtcgggcattttttatggccgtgtttttcatcaattgttgttgaaaggtgccggcaattgaccccggatactcgttcgtcagcatgtacgtgtcctattccgacctccggnnnnnnnnnngccgaaatgcctggaagtcggcttaggacgacgctagccaagcaagtttatgcaaaactcgaactttttccagcgggccttagctggttgtttttggccttatagcggcacctttcaacaatttttcgtgtataagtttaagccttcaatcccattttgtctgcgtgccaatataaataggctttccaagacatcgtccgtcttggaaagcctatttatgattagttgctcaccgataactggggtcactgaatgacaagtcctgccacgtcacgctagttttcaactttttgattaccaaaccatttcttgttgatcttatctaacgttccgttagccttcaacgtctttaggccggcattaattttgcgtttcatcgttttgtcacccttacgcatcccaactgcgaagtcttccgacttaaaggtgccttgcgtttcttggtaatccgcagagttcgcttcgtgcttaatataatagctcgcgtagacgctatcaatcaagagccctttaattcgtccagcattcaagtcgaggaaggcattcgtgaaggtatcgtattgaactggcgttttcttagcaatcttatccttcagcagtttcggattgttttccaatgactcatagcccgaagaacctgactgaacacccaacgtcttaccagtcatatcgtcaaatgagttaatatgatttttctttaaagaaacgaggacttgcttgttcttcaaataagtattactgaaagccaccactttttcacgttggggatttttcgtgtagccgttccaaatcaaatcaattgtgccattgcgcaattcggtcgcattcatggaccagtcaatcgtttgaaagctgatcttaataccgtacaacttaaagacggcccgggcgaggtcgatatcataaccaactagtttcccagacttttcgcgaaagcccatcgggacaaaactgtcgtccaaaccaacgacaacgtaaccgcgtttcttgattttagaccaagtatcttgggtgtcagcgcgtttagtcacattttgaccacagccacttaacgtcgttgccatacccaggagcatcacaacgatcaaactgagtgcaaataatcttttcttcattctgacgccccctattgcttcttggttggttcaacgtggaacatttcatccgcgatattttcagcaaaggttaaatcatgggtcaccacaatttgagtcatgccatcagcctttaagcctaaaatcaacttttcaacttcctgtcgtaagttcgggtcaagtgctgaagttggttcatcatagcataagacattcggtttcatggctaatgcccgggcaatcgccactcgttgcttttgaccacctgataattcgaaaggatactggtcagcgtgatcaccgagattcaaacgatctaataaagtctgcgcctgctgttctgcttctgcgctagactgctttaagaccgtggtcggtgctaaagtaatattctgcatgactgttaaattgggaaacaattcaaaattttggaatacaacaccaatcacactatcgttactccgattagtataggggtcaaatggttggccgtcgactaagaactcaccggcattcaccttttcaagccccgtaatacagcgtaataacgttgttttaccagcacctgaagggcccacaatacttagaatctcgccatccttaacggttaaattcaaattcttaataattgtccgtgaaccaaagctttttgtaatattttttagttctaacatatgatggcctccctatttccagtaactgtaatgtttttcgattcgtccaagcacaaaagtcgttacggctgtcagtgctaagtaaatgattccgactaatactaagggtaccaaagtaacatcgcgcgctgtcgcaacgttaccggcacgtaacaagtcgccgagaccaatgacataaactaacgatgaatccttgaccaagttgatgacttcattgccaactgacggtaaaacaattttgatcacttggggaataacgattttacgaatcgtctgccagtagctcagccgcaagacccgtgcactttcatattgaccattgtcaatcgactgtaacccaccacggaagatttccgcgaagtaggccgcgtagttcagaataaatgcgaataacgcggcgtagtaccgtggaaaaacaatcccaatcaacggtaagccgtaaaagacaaagattaattgcagtaacaacggggtaccacgcattaaccaaacgtagaaatgcaataaccattgcagcggcttgaagttagacattaatcccagaccaacaactaaccccaatggtagcgacccaatcagggtccaaatgaaaattttcagtgtcataacggcaccggataataatgatggcaaaatttctaaaatatactgcatgtactttccctcccaaatttacaggtcacattgtcctgcgtccactaatcggtcacgactcaagtacacaaaaaagtccccttgagtcgaatactcaagaggacggttatccgtggtgccacctcacttcgtaataacttcacagttattacctcagggagttttgtgataataaaaaaatcgtccttaggccagcatgcctaagaggacgatttaatcgcggttccacctcatattcactagttgctcacacaactaatctcaacgagtttatcactaaactccgccgctaacgaggccaaccgaaacagcttactaacttcagctgtccaactcacagatgtggttcgttgtaatccttggtcatcttcccatcatcgataactcgctcggcaaggtccttacaactactcttctgttccctgttttttaatgttgagttcatactaatcgaaaattaatcaaccgtcaagccttttttacttgccacgatgaaaaattccggcgattcgtgaccaaacacccggtttaggtgtatccaaattcattaatggcaccgtttcaccttcgattcggcgggcaatgttgcggtagccttgtgaggctggattcttaggatcaagaacgatcggttcaccgttatttgaagtccgaatgacggcatcgtcatcgaaaacgattcctagcaagtcgatcgataagtgatgcgtaatttcatcaatatccatcgtctcaccatcttgcatcatgcgcgtccggattcgattaatcactaacttaggtgcttcggctaacggatattgttccaataaaccaacgacccgatccgcatcacgaattgctgaaatctcgggtgtcgagacgataatagccgcatccgcaccagcaatcgcattcatgaaaccttgttcaattccggcgggacagtcgagcaaaacgtaatcaaaatctggtttcaactcgtctacgattgcccgaacttggtcaggattcaatgcatccttgtccgcattttgtgcagctggcaataaaaacaataagtcatcaaaccgcttgtctttgaccaacgcctgccgtatttgagcacgacctgcaactacatccacaatatcataaaggatccggttatcgagacccaaaataacgtctaaattccgcaatccaatatctaaatcaactaagcaaactttcttgcccatcaaagcaagggccgtccctaaattggccgtagtggtcgttttgccgaccccacccttaccagaggtgatgacaattgcttttcccatcaaacacgtcctccatttcgagtaaatagcttcggtcgtacccgttttaattgctggagcggctggtagtccaacgcttgaatgtcattaatatagacgacgttcgtcccatcaacaactttttcaagatccactaattctaacaattcaccgactcgaacccgcgggacggtcgctaaggggctaacgatcaccgcatcattgtgatcgggataaccggcctcaagcgcaccgtttacctcacccatcacaaagatactacccgtcgcccggagcaccccaccttcatggatcttaccgaagaacaacacgtcccccgtaatctcaacgacctgaccgttgcgaataatctgattaaccagatgcaccgtatcacgttcaatcatcgctaaagcatccgccgtcaaaataacatctgccgttagcttatgaatactgaataacggatatcgttgaatcaactgtgtcactttttgattttgttccgcagtcagtagtcgactagccgtatccaggtcaaacgagatttgtttatcagtcgtattatcagcctgcaaccgatccaacaagaccttcaagtcgaccataatatcatcgaaacttgcttcttgccgtaaaatcagttcatagccgtcattactggcctttaaaactacactctgttgcatgttagaattcctttctgccgactaattaacactcagatataaccgacgcattggataatataatatgacaaagatggctaggttgaccgcaatcgtcggtcctagcgtgtacaccgcaaagtctgctaacccactagagatcacatggctcatcgtgtaccaaatatacgtaaatgcttccaaaatggtcaaattaataatatagatcatcagtaacgttaaaaagttcaggtcgatccatggcttgatttgtcgacatatatagactaccaacggtaagccaatcatgtaaacgcctaaaatcccagtatagtaccagtcaaacaccaagcccacgaatgcagaccagattccaaccgacagattatcacggtcgtctaaaaagacagcgaagacaatccacagtaaaactaggtgtaagacactggcgtacgggtaactaaatagtttaccggcaaaaacatttgacaccgagccgtctaaaaagagtgcaacaaataacccaattggaaagatgatttttaatcttgagtaacgcaccgttgcacctccctactgttcagcgaccgtcacaactgttaagtcactaaggtccgctgcgggtgtgatttccacttcggatgctagcccgtaatcatcctgcttgacactagcaaccgtgccgacataaagtcccttcggcgtattgccgcctaaaccactcgtcacgactttatcgccttttttgattttaacgttagacgtcacggaacccatctctaaaagattattgctcttatcataacctgaaataatcccgttaacagtcttaccagcactattcgtaatctgaatagcaaacttattcgaagacgaactcgtattagaaattaattcaaccttagaattcgtttggttaacttccacgacccggccaattaaacccttttgtgacatgacaggcatattcttctttacaccggatgtcgcacccttagagatcacgagttggttcatccaagatgatggtgtccgcgtcaaaacattggcggtcaccgtcgtataatcagataacgaattatttaatttcaactgcttgcgtaactgcttgttttccgcacgcgtcgtctgggcactaaccttggcctgcgccagttgatcaacttgcttcttcaatttttgattttcttgataggtgttcaacaagtcagaaactgagttggtcgcactttgtaagccattgactggccaagcaatcacccggtcaaccgcaccagccacatcgtttccaaattgttggatcaatggtggtgtcgatttcttatcacgaatggctactgagacactcatcaagccgaaactaataatgaacacgacaatcgcaatcactagttttcggttagaaaaaaacttttgcataatgaacccccggtcgaaaattcaatgatttaacaataaataagcgggaagacgtcttcccgctcacctgttatcgctttttcataacgtcgatgctcttgagtgattcaccggtcccaactgcaacacagtcaagcggttcgttagcgatgaaaaccggtactttggtttcgtccgcaatcacttcggaaagattcttcaataaggcaccaccaccggtcaaaacaatcccgtggtcaattacgtcagaggcaatttctggggaagtttcttcaagggtttctttaatggctgaaataatttcagagaccacttcttggatggcttctgaaacatctacagatgagatttcaaccgtctttggtaagcccgacaaaagatctcgtccacgaatcgttgacccttccaagtcttcagcggcttccaaagatgctgagccacagtcgattttaagttgttcggctgtgcgttcaccaattaaaagattaaacttctggcgaacatggtaaatgattgagtcatcgatcttatcgccagccattcgaattgaacggcttgatacgatcccacctaaggaaattgtcgcaacatcggtagtcccaccaccaatatcaacgaccatgctcccagttggatccatgactggcagccctgcaccaatagcggctgcaaatggttcttcaatgacatatgcatcccgcgcacctgcaacccgtgttgcatcaataacggcccgcttttcaacttcggtaaccccacttggtacacaaaccatgacgtatggcttaccatttgagcggccgagtgtcttttgaataaagtacttcatcatcgcaacggtcgtatcgtagtccgcaataacgccatccttcattggccgaatcgccacaatgcttgctggggttctcccaatcatatcccgtgcttctgaaccaactgatacaatttcaccagttttcgtgttcttcgcaactacggatggttcacgtaatacgatgcccttgccgtcaacgtacacaattgtgttggccgtaccgagatcgatcccgatattctttgtcccaaatccgaacactacattcatcccttcatcattaacaaatttaattttttatttagtcataatagtaagtattatagcatagtcgcactgcattaaaaaagcattgcctgaatcctagcataccgtaaattaatgaaaaatacagtcccactatttaacttagataaaatttaacaaaaaaacgcgatcaggccgattaaattatcggtcctaaccccgttattttaccacattctgttacgaatccgtattacaatttaacacgccctgctcggcaaaactaaagtaatcgtttacaccgataataaagctatccaagagcggtaaccccatcagttcacaagccagttgtaaccgcttggtaaattcaacgtctttttttgacggcgtcacatcaccactcggatgattatgtgcaataacgacccgggcagtcggtgtcgttagggcaactttaataatttcccgcggttgagccggacaactattgagcgtgccctgaaagacgacctggcgtttgatcacttgatttttcgtatctaagcataacaattgcaactgttcctgctctaagttggcaaagtcccgtgctaaaacggctcccagttgttcactaccatatacctgccccaaaattaatcgacttggccggggtaatagttgcccacatctgagcgccacgattaaaccttgccagcgcggattttcagacgactcatgtaaccactctatagcgtcctctatcgggtactcacgctcaaaggcctgcatcgcgctagtcaccgcgtcgttgggtaaaaacgtcccaaagtaggcttgcattaattcacgaacttgtgctgtcggtatttgttcttcgctgatcatcgtcattgaaaccaccctttctacctagtagtttcgtaaagtgaccggctaaccattaattcaccgacattttaacgcaattttttcagttaactcacaatcatctttgataatatcagtaccaaggacgcagtattatttcttgcgcaattgtcttctaagcatccgtgtcagcccctaatcagtttctgagtcgctgccatccttgaaataagcccgtacgtcactaataaagtacagcgaccccgttagtagtaacgcatcatcactcgacatttcttggagtgtctgcatcaaggcagcttgccaattatcaaatacttcagcggtccggccatttggcatttcatgtgccaacatcgtcgggtcggtcgctggacgttttgcgttcggaccttcgaattgtgtcaaccgtaattgaacattaggtaatgcgcccaaggtctgaatcatttgttgatgctgcttatccgctaagaccgcaaagatgacataaacggtttgctgtccaaatcgctcactcaaagtagctgctaattcagttactgccggctcattgtgcgcaccgtcaatcatgatcagtgggtcctgattcaagcgttcgaaacggccaggccattgtgttgctgtcacagccgctttgacgtcgctagtgaccacgggtagctgagtcgcttggtggtaagttaggtacgccgctattgcaacggccgcattatcaacttgatagtctcccagtagcggagttgtcaagtctttaaaatgcgcctctaacccgtcaaagttaaaccgttcttgccagccttggggcggtaataatttggttgtaaaatcaactcccaacgtccgcaacggcgcccgtttgctcatggcggtatcaatcatcacttgctgtgcttcagccggtaatttaccaacaattaccggcacctgcgtcttaatgatacctgctttttgagtcgcaatcgccgtcaatgtattacctagaatttgcatatgatcataaccgatcgtagtaatcacactaacggctggtgtccaaacattggtagaatcgtataacccacccaacccaacttcaataatggcaatatcgattggctgagcagcaaagtaaagaaacatcattgcggtaatgatctcaaattctgtgggacccccacttgccaatgtcgcgtcaagcttggcaacgatcggttgaatctgttgcaccagaccaacaagttcttcatcgctgatgggggtgccgtcaacactgatccgttcattgaagcgaacaatgaacggcgacgtgaaagttcccaccgttagcccatctgccataaataattcgcgtaaattcgcaaccgtcgaccccttgccattggtccccgccacgtgaatgccggccacctttaactgtggatcacccaattcatgtaagaattggcgcatacgactgagtgtcggggcttttttgaactgagtccggccgtgaataaaggctaatgctgctgaataagtgtcaatcatgttggtcttccttcctgtaaaccgcgcgaatcatcatttggccgtttgctcaccatacttctagctaatgagcccttatattttacgttttaataataaaatggtaaccatcccaaaacgggacgattaccattttaccagtaacacacatttcagttaactattatcgcaaattaagcttcagccttaatatcaactaaacgttgctttaaggcagctagttttgtctgattgtccgctaacttctctttttcactattaacgacgtcttcaggggcattggcaacaaagcgttcgttacctaacttcttcgtcgcccgtgcgacttcgctttcaaacttggcttgttctttttcaagttttttgacttcttcatcgaggtcaacaagttcagctaacggaatgtaaacttccgcatcactaatcacttgtgtcatggctaacttcggtgcaaccacgtcggcgccaattgacagtgtcttcggatgtgcaaaccgttgaatataatcttcattagctttgaaaacagcttgtaaccgagtgttgtccgtcttaattaatagatccacggctgatgacatcttcgcattagcttctgctcgaatgctccgaacggccgtaatcaattcaataagtgaggccatatcactttccgccgtttcgtcatcaaattcaggatggtcaacaggataagcagcgactactaaggattcaccaacgtgtggcattgataaccaaatcttttcggtcacaaatggcatgattgggtgcaataaccgtaagatttgatccaagacataggctaacacgttttgggtattggccttggcttgagcgtcatcaccggtcaagacttccttactcatttcgatataccagtcacagaagtcattccagataaagttgtacaaggctcgaccagcttcaccaaagtcaaacttatcaaaggtagtcgtcacttgtttgaccgtcgcgttcaaacgactcaagatccacttatctgctaacgtccagtcacttgcagctggtaattccggtttgtccatggtgcccaggttcatgataacgtaacggctggcgttccaaatcttgttaataaagttccatgcagcatccatctttgtatagctgaaccgcacatcttggccggccgtcgacccgttagataagaaccaccgtaatgcatcggccccgtacttttcaatcacatccattggatcaatcccgttaccgagtgatttgctcattttaacaccatgttcatcacgaatcaggccatgtaaaagaacattcttgaatggtcgccttcctgtaaattcaagactttggaaaatcatccttgaaacccagaatggcaaaatatcatagccagtcactaaggtattcgttgggaaatagcgcttaaagtcttccgcatcagtgtttggccagcccattgttgaaaatggccaaagtgcacttgagaaccaagtatccaacacgtctggatcctgttcccagttttctggatcttttggtccatcaacaccgacatacgtttcaccggtcgtcttgttataccaagctggaatccgatgtccccaccagagctggcgtgaaataacccaatcatggatgttttccatccactgcttaaaggcatcttcaaaccgcttaggaataaagtcaacggcatcgtcaccctcttgattcttcaaagcttgttcggcaagtggcttcatctttacaaaccactgggttgagagccgcgcttcaacttggacatcagtccgttcagaatgcccaacgctatgcacaattgggtcgattttaatcatcaaatcttgatcttcaagatccttgaccatcgctttacgtgcttcaaaacggtccataccttcgtatttacccgcattggcgttcattgaagcatcatcattcatggtgttaatccgtttcaaatcatgccggttgccgactttaaagtcattcgggtcatgagcaggcgtgattttcaccattccagttccaaactcagggtcaacgtacgcatcggcgataattggaatttcacgttctgctaatggcaagatgacttttttgccaaccaattccttgtaacggtcatcactcggattaaccgcaacggcggtatcgcccatcatggtttcaggacgagtcgtggcaatttcaatgtaatgtttaccattgaaagtatagtctttgtcagcaaatgggtacttgacgtggtagaacgcacccttgtcatccttatgaatcacttcgatatcagacaaagccgtccgtgcttgaggatcccagttgatgatgtattcaccacgataaatcaagcccttgttgtaaagatcaacgaagactttcttaaccgcatctgacaggccatcatccatggtgaaccgttcacgagaatagtccaatgacaatcccatcttagcccactgttgtttgataatcgacgcgtattcgtctttccaatcccaaacttgttgaataaacttctcacgaccaagatcgtaacggctgatcccttgttcgcgcagtttggcctcaacctttgcctgtgtggcaatgccggcatgatccattcctggtaaccataaagtatcaaaaccttgcattcgtttctgacgaataataatatcttgtaacgtggtatcccaagcgtggcctaaatgcaacttacccgtgacatttggcggtggaatcacgattgaatagggtttagctttcttgtcgcccgaaggcttaaataaatcttggtctaaccaagtctgataacgacctgattccacggcggtcggatcatacttagttggcatatcagtagttggttcttctgacattggggcacatcctttcttttggcactaaaaaagtccactcatcctattagactaggacgaatggacttcgcggtaccacctaattttaaagccatcacaagtgatcgctttacagcttaaacatcgttgttaacgaacggtgtatcccgtccggctattcctactaaaacagttcagaatagcagctcgcaagctaccttcacgctaaaaccgccaagcgtgtttcactgttcacgctctctctgttgacgttgtttatcgctactctcttgctcattgctggttgtcactattgtaatgaatttcctgagtgccgtcaatccttattcgaattgttttagggcatccagtgccgcaacgtaatttggctcgtgactaacatctggcacgatttcatgataaacgattttaccggccgcatcagcgacataaatcgcccgggtcaacgtcccattgttgggcaagtatagattggtggcgtaaccaaaggatagttcttcatcggaagccaccgttaagttcttaacgccttccttagcgcaccaaccagcttggtcagcaaccgcgttattggaaatggctaaaaattgaacgtgggggtacttatcagcctgttgattgaacttctttgtttgaatagaacaaactcgcgtatcaatatctggcatcacacttaacaagacaggcttacctagcaagtccttagtcttaatcttttcatcatgggtagtgaacactttgaacttcggtaactggtcaccatcttgtaacggttcaccgactaagtctaatgcttgatcatgaaataatacttgcacgtaaaacaccccttcgataactaatggttttctaatatttgtggtagtaatagtatagctcaaatttaacgcaatttcagtttccgcgcaaataatcgtctcaaaaattatcattcttgacatgcgacgcgttatttgacgttagtcatggtttaaacgtgcttattagttggtttgttgttcgtcagccgatgtgcgtcctaacgtgccaacacgtgtgtacgccgatttcagtatattcaagcattaaaatgtggtgtcgtagccagctggagtgcaagttgggttgcacgttcgagcgaatcgtttgtttgttgttcccagcgggcagcgagtgtgttggccgggtcgtgcagactagttaagatatgttgggcgacttgcaacgcgtgtggttgatgtaaactggtagccatagtttgtagcgcgtcagctagttgttcgccttcagttagctgtcgagtcacttgcatgggggtttcgatggcaacttgttcgttggcgcgctgacccgcctgaatccaattatccgtactagctggcactggtaaccagagcatcagtaaaacgaaccacgttaagcaggtcagttgggacagatcgatgcccgcaccggcccatgggttcagatctaagttacgtaattccaagtattgaatcccatcctgacatagttgtgaatgaccaccagcatgacgcaaccgaacctgaccgtaaaattccttggtcgcacttaattttccattatcaacggccgcttgcagtgtttgacaataatcatttaacgacgcgtacgagaccgtaacacccggccgattggtatacccgctagaactgttgcgtaagcttcgaacgggctgggctggtggcgtaagaccagactgtggccagcagcatggtgagcagccataaagatacgtcagtagccagcgatagtgcaaataattctgcgcaatgtgcaggtaacagtgattttgaaaggtggtgaaatcacgactatctgtctgggcctgatacaatcccatcatcagactagccgccaagctcacattacagtgaacacctgacaacatttgacgtcgtcggccatagcggtgagcaagtccttgtcgataggcgacagcggccgcatccaacttagcgattggaatatcccggtcttctcgtggaagtgtgggcggcatgcttagcggccaaatcagttcaggcagaagcctttgccggacttgttgtgtgagcatcgttaaggcgtgcaacgcagcaaccgcacttgcttgcggttgggtgactaactccaactgtgtctccgcaaagtcccgttgcaggccggacaactcgctgataagtgttggtgataatgccgtatccgccaaatgaccggtcaccgttacccgctggccttcccgttccagcccaatctgaacaacctgtgcattgatcaacgccgtattttccattaataattgttgccactccatccactcacctcgctgattcaatctaaatttatcgtagcatagtcacgaccttggttcgctgattatgacctattatttagctgacttaccattacgaaatgagcttccgcgcgtccctgcttgatcatccaaaaaatcaaaaaaacgagtacccagtattaccgggtactcgtttttagggtaataatatcacccgtttttgacctacaatagttcagcaaaaacgtcttcttgtgtattcaaataattttcacccggcttgatctcagtcattttaacaccagccaaagcgcgtgccatcagtccttcaacatcaatccgttcttcgtaggaccgtgaacggtctagcttcggatgcgtcttgggtgctggcggcgcaaaaatcgtacaacaatcttcaaatggcatgatcgacaagtcataggtatcaatatcttcggcaatcttaataatttccgtcttgtccatggaaatcactgggcgcaaaaccggcaaggtggtcacatcattgatggcaatcatgctatccatcgtttgtgaagccacttgccctaatgattcaccattaaaaatcgccttaccatgccgttgacgcgtaatggcgtccatcaaacgcatcattaggcgccgttgaacggtcataagataaccctcgggcactttttctttgatttcttcttgaatctcagtgaatggaatctgaataaacttcacgctaccagagtaacttgctagcgttgacgctaactgcttggcctttgctaacgcctgttcactcgtgtatggcggactgaagaaatggaccatttccatgtccacaccacgcttcatgccaaggtagccggcaactggtgaatcaatcccaccagaaagcatcagcattcccttgccagcggtgccgaccggtaatcccccggcaccctgaatcgtttctgatgataagaagataccgtttaaccgaacttcaacacgtaacacaatgtccggattcttcatcttaacttgaatcccgtcaacgtggtccaagatttgcccaccgagcatgtcattgatttgatttgtatcgtattcaaactgatgatcggagcgccgtgtgtaaattttaaaagtcatccccggtttaaactgggctttgaccatcgcaatcgccgtttcatagacggcatccatgtcggcatcgacgcgaatacttggtgaaaagttttgaattccaaaaactagcttcaaacggtccatgactttatcggcatcctcaccatttaacatgatgtgcatccggtcacggttcgcgtggacctttagttctggaaagtcgtgcaacgctttgcgtacgttacggcctaagctatcgataaagttccgccggtttttacccttggtcgatagttcaccataacgtaccatgatttcagtgtactgcatgaacaagttcctttccgttatgcgtctgcattaatttttgagaatttttgataaagttgatcaaatactttaataaactggtcagcttctgccagcgtattattctcatcgaggctgacccgcacagcactcgtcgcaatgttttcttgcacgtgcatcgccattaaagtactggaggccaagtgtttcttcgatgagcaggcactcgttgttgagatataaatgccctgatcttcaaacgcgtgaacaatggtctcgccccgcacaccgttgatcgtaaaacacagtatgtggggtgcgaaccccgtcgttggctgactgaaaatcgtcactttaggaaacgacttaatatgctcgtagattcgctgtttgatagctcgctcacgagctaccttaccatcttcatccgtgagcaacaatcgcagggccttcgccatgccggcaattgctggtaagttctcagttccagaacgccagttactttcctgaccgccgccattcattaatggcgctaacttacgaccattgcgcgcgtaaataaagccaaccccgcgagtcgcatgaaacttgtgccctgaaaaggtcacaaaatccacccggtcattcatgatcatgttctggattcctttaccaattccttggactgcatcaatatgaaaatgaattttcggatattgtttcagtagttccgccactccaagtaaaggctgaatcgtaccgatttcattattgactgccatcgttgacactaaaatcgtgtcaggccgaattgccgctttcaagtccgccacgttgatgcggccttcctgatcgaccggtaagtaagtcacttcataaccaagttccttcaattgttccatcgaattatgaatggcaggatgttccaccgccgtggtaattagatgcttcccaaaggcccgcttttcaatcgctgtacccttcaaaacccaattatcgccttccgtcccaccagacgtgaagaaaatttcgtgggcttgcacacctagtaagccggcaatttgttgacgtgattgttccaacaaatgaaaggccgtttcaccaaagttatgcaaactagacggattaccccaaattttttgggaaaccgttgtatacgtctccagtacggcaggagcagcttgcgtcgtcgcactattgtcaaaataaatcattactacgccttctctttccaagaaagtgtgcattgcacttactttcgataagaattctttgcaattataccaaatattactagtgaaacaagggtttttgtttcaaatttctgattaatcacacgacaattgcgtcctaaacaccatttttgttggccgttcccagtcacccttctcagaaccatcacgactacttgcatcatgatgccaactaaaaaccagctggtggcggttgtcatttaacaatcaccaccagctggttattttcagttaactaaaattttgcatatgggcggtcccaactatcctcgtcaggcctcatcgttcatcttatcagcttgtttgttcgcatagtaactgtcctcaatccgtttataggaccccggatcaactttatccacagctgttgcaattacttctaaactccgcgcgtagtcatgagtctcggtaaacaaccgttgtgcttccacgctggcttcttgcacctcttcatgattcgtcttgtaacggttagcgtattgtaagagctgttccgccataaccgcagcatccgttaaatcactggtcttttcctttaaggtcgccatgtccgcctgaataacaatcaactgtttcgtgatgtcttccatattgatcacaagcttattaatatcatggtcaagccgttcgatttccttggcaactactttgaaatagtccaaatagtctttcggtagtccaggcaagttcaaattttcaacctggcgtttgatcgcgtggatttcaaaatcgaaccgttgcagcgtctcgtgggctttggactcttcagcggtcaaactcgccacacctttgttaattgccacttgttcttcttcaatgcctttcaactgctcatcttgttcggcaaaatgagctgcgatctcactaaagacagcttgcttactagtaatagctgtgacgtccgcctgataaacagcttcgatattcttcagttgttcgttcaattcacgcgtccgttcaacttcgccattattcaacgtatagctttgtgctaatcgatccaactcaatttgtaagcggtgattctgattcatggcatgtgtcaagaacttactgatttcttcttgttgttgatcaacaacggccttagcatcgatctctgcttgcatcacgtcgtataagtggtcgatccgcttttcaatcgcatgattgccgttttcagcatccgtaactttcaaatcaccaagtaacgcaatattatcgtcgattgcttgctgtaacgctttgatttctggatcaatcgattcgacctcaaagtgaaaatgttgagccgttaattgttgataaccactagccagttcggctaactgatcaggaaacccactcactaggtccttataaatcggtggaatccgatcaatatccatttcaagagtgccagtatcgtgatgtaactgatccaaaaccttttcagccgcgtcatgatcgccagccttggctaattcggaaaaatgatcaaaatcactttctaagttagctaactgatcctccaatttgtcgatgctcggaccaaatgaaaagttttgcgataataacgtcttccgtatgttttggtacttcttctctaaactagccactgcttggcggtgcgcggcatccgcgtcatctaaggcctgcaagccctgacgaatttctgcctgtcgttgttcaatcgtatctaatgtggccgcaaccttcttcagattctgctgagcatcgagaaatctgatgccccgcgcctgcgaagtaatggccgttaattgctcactaacggcgggtaactgatcattatcaacttcttgaccagcgctctgcaacgcttccaacttcgctaacgatccgcccgttagtccgagttgttcaattttttcgaaatctgtggtctgcgattgcttgactagcgcctgttgccgttccgtcaattgacggacttgcttgtcgatataaaattgaaagcctttgaccgccgcgtagatgacaatcgcaaccacaacaatgccgattgctacttgcatacgaataccccttacattatttattccgttttaattgcgttgcgcctcaccctgttgagaaccgtaaccttgcttttttctgaaaatccaattaaaatctatcttaaattataacatagacgtaactaacggacagtaacaatttattaacattcaaggaggattttttacatggctaccacggaaacatcacttatgaaccaacaactcgacgccctactgtttcaagaaactaacctggtcgcgaacttagctaatgctagtgccctcctcaacagtacttatgacaaccttaactgggccggcttttacttatttaacgaacaaactggcgagctcgacttaggtcccttccaaggcaaagtcgcttgcatgcacatcaaagttggggctggtgtcgtcggaactgcttttgaaacgcaaacgaaccaacggatagccgatgtccatcaattccccggccacatcgcttgtgacagcgccagcaactctgagatcgtggtcccaatcaccaaggacggccaccaaatcggcgtactcgacgtcgactctccatcattagaccgattcaatgctgataacgaagctgaattgaccgaatttgtggcgattctgacgtcacacattgactaatcagcattaaacgtgttatgctactctttgtgtaaaataatgcagcagtgagtgggtaagctcgtcaacagattggtgccaatattttggtcagttagtaacctgcggctgcaatggtgaaacctgcagtccaatctgaacgaatatcgaacttacatcggattattttactccaactaaaattattggaggaaacattttatgtctcgttatacaggtccaagttggaaaatttcccgtcgtttgggaatgtccctttcaggtactggtaaagaattagctcgtcgtccttacgcacctggtgatcatggccaaggtcgtcgcggtaagctttctgaatacggtacacaattacgtgaaaagcaaaagttacggatgatgtacggtttaactgaacgtcaattcgctaacttattcatcaaagctggtaagattcgcgaaggtaagcatggtgttaacttcatgatcttactcgaacgtcgtttggataacatggtttaccgtttaggcttagcaacaactcgtcgccaagctcgtcaattagtaaaccatggtcacatcactgttgatggcaagcgtgttgacatcccttcatacgaagttagtgtcggccaagttgtctcagttcgtgaaaagtccaagaagttggctgttatcaccggtgctgttgaagccgttgttgcacgccctaacttcgttcaattcgatgctgataagcttgaaggctcattaactcgtttaccagaacgtgaagaacttgaagcagatatcgacgaatcattaatcgttgaatactacaacaaactttaatttccggtatttaaaaaccgtcgcgtttgcggcggtttttttgtatgttctgttaatttcagacctgacgctcagcactcacagccgccatgaccggttgataaatcgacaataattgtttgaatgttgtgatgatcaatttattcaacgtatcagcatcttcaaataacggatcaccgaccaaaactgcgcggcccacgaccaactcgctgtgtttatactgatcgaatttcttgatggcctgcgtaatattggccggtgttgcaagttgcgtggccggcaccccatgattattactgataacatagcccgccggcaaggccttcaaaagtggtgttaaatctgcgagttgcatctttgcctgcacggccggtttacactcatccaaaatatcaaaatagataaacaaacggtcaggccatagccccaattcaaaatgtggccaggctttgtagctccgtttgttttgactaaaagcgacccaagtgtctaccggtggattcttaaatcgccgtaaatgtttggcaacgtgcgcgtagaacggtggctcgctaggtgtttgtaaactcgctataatcgttggtgcgacctgttcgaacttaggatcgatcaccgttttgattaaatgcatgcggcccgctaacgtctggtcattaaaaatttcaaaatcttgatttgtaaacaagttttatcatccccaaaactaatttagattaaccataccgcattcactaacgcaacgctaccccccttcccttcgctattattggaggaacatgctacaatgataattactatcaaggaaaggatgttagacaatggctgaaacagataaacaaccagttgaccgcatcgaaacggccatgcacgggacgccaaagttgcatcccgacgaacaacgcaagtacctggggacctttcgggaacgcgtcgaagtcgcagtgaccgttgcccaaattaaacaggccaattacgtcgacgcacttcatcaagcatttacgagccatccggatgaccaattatatattaatggtaatttagaccaggaactgattgggccgtatatcaaggcggctagtcaagccaatatcaaattcactatcaaaacggatgacatctaccacactgctgatgatgattacgcgcttgtattcactgctgcaagcgccattaaccaagatattattgatgttgcgcagcgttatccctcgcaggcttcatcagcaacaccccaggtcgagaaaacacctgggttgctagataaattcaaaaagttactttaatacaacaaaggtccccatccacgcacggatgaggacctttttacgtttgactgcgttaattacgcgctagagtgccataaagactcatgataactaaggccgcaacaatgatccccatgaggctgactgaaacccatgctgttgtgacgatactcagtagtaacaatatcccaccaccaactagcgtatagcccaaccaataacgaacacgccgccaaatcattggccgaatcgtgtgaccacctcggtgcatctgcgcgtattgatttgcactgattgttggcaaataattcccgatggccatgaaaataaaggcaatcaaactaacggcaatacgccaaatatccaattgatggtctaagttataactgatagttgtcgcatagatcacacttgatagtacaggcacgatccaaatgatcatctgttcaaaccgtggcgccggtgccttatgattggcattcaaccgtgtcaccccaacgcaaatcagctgaaacgccatcatcataattggaaagccaacgaccactaataattttgcggccattccattaggttgattatccaaattaaaatgaatagccattttggcgggcaaggccgcataattcacgacgccgtagctcattggtaacagaataacaatatagctcagccacaactgcaagttcctttttgtcatcacttttcatccccctgctttggactaaaacgatatagccacgtcaacatttcctcaaatacgctcgcatttagctcatagtacacataatttttttccttggtcacggtaactaaaccagcttgcttcaaaagcttgagatgataagacaccgttgcattacttaacttgaaatgagccgcaatctcaccagccgattgccgattctggcgtaaatcttccataatctggcgtctgacaggatctgcaattgctttaaaggtcgtattcaacgccatacgggctacctccaatcacctatttagatatatatctaaatagagtataacaggcaaccaggaattcaacaagagatatttagataaaattcgaaataggtgttttcaatcatgacacttaattatgagctatcaaaaaagctggacaaggccagctttcttgtttttaatcttcatttttaaacaatgcatccaacaactgccccgccactggttgggcagtaccaaacattgggaacaagtgcggatacaagtacggcgccgcatgaatacccaagtataccgccatttcaggatgctctggcactaattcggcatagagattgggaatcatcacgtcgaccccagcgaccgctaagtgtaagtctgctaccagcttttccaccgcctgcacataggattgatgcatatcagccgtcgcgtctaacacgtccgccccgttaccaaaagtcgcatcctctcgtaataagatttgagttccccggctgaccacagaatctaaggtcaagtgatatgagtccaggcgataccgttcgatcgttcctaactgtagcgctgattgaggccacttaaaagcggtcccgcgcaacgctcgaccatttttgcggtcaagtaacgtcttgactgttgagcgaccatcaccaacaatattggctggaattcgttcgacgattgcttgcacacgaccatcgataaccaaaaagcgataacttgatgcgactaccacttcctcggccattaccgcggacgtttgctcaaatagttgccggacgacttgttcaaacagtccgcgttcgggcataatccgaaagacaattactttgtgcgactcatccgccgcttttaatacgatcccaccagcttgaacgtaccgatcataatcagcaatcaactgattagctgtatgatatgtctgtgaagccggcaccggaaccccgtgctcagccagaatttgtttggccgctgctttatgtgtcagtacggtcgttagcgcctgtggatttaaatccgttccgctcccattcacaactaattgcgaccgtcctaacttagtcaatcgtaaaatgttagcgtgtgggtcaacaacgtccacctgcactccccgcgtcaaggcctgctgggctagttgctggctcgatagatttagcgcggtaaagcccgcaagttcaaacggacgttcattgctcgattcctgatagcgtgcagcccgttcgagtgcccatgctaacggatcggcttgcatggcaatctgcgcactcagcgtcttctttggatcagtgacccgcgacttcaactgtttgagtaacacggcatcttcatttggtagtccataggttttaacaaaatcagcaagtgcatctaaaacttgaacagccggcacggcctgagcactagccgtcgttggattttcacccaaaacttgacgggtcaattggtcagcttgagcgttgacttgggataccatcttagctggaagtgccggcatcattacgaaataactcgccaacaaacgaacaaatgccaccgcgttcgcgtccaccccgactggactagttggatcgagatccaagccccggtattcaagataatagaccccctgccgggccatcatagctagctgcccattactccgaagccgaactggcccgtcaaaatcattgaccgacaacaactgctgttgacgaacagccgccgtcaacttggccacgtagcgatcaattgacgtatagtctcccgtcacttgactgtagcgaccatcgggatgttgaacactactgcgctgtggacgactcgtagtatccgtaacggctaggcgtggtgaagcgccaaataaatactgaatcagccagttcatgcgcaccaatccctgagcgactttcagataaattgcattgcgaaagtcaacataactgtgatactgctgatggaaagtctcagtatataaacgggtgaataaagcttcattcaagctcatattcacgtgactaccagtcgtcattaatcgctgtaactcatacttacgagctaagtcgcgacgacgctgatagctgacttgatcaacatcagccagtggcacgttcgttagatcatccggcaacacaggcgtactcgacagtggccaaagtcgttcgtccgcatcgagtgaccgccgtgctgcggtattcaagcccttcagatacgccatcaatgcaggaatgtcacgacgcaccggcgtagtaaactttaaagcacttgcggaaaagcccggacgtaactgatgattttgttgcgctgatccaaacgcttgcgggtgtgctgtcgtcgctaagtgaccatggtcgtccacccggtgcatggtgacctctagtcctaaattagcctgatgaacgagtgggactaagtgatactgtacaattgccttaccaacggcatctaattccataatgatcaatcctttataattattttgttcgttaaactgattattcggtgtccttcattgtaaatgctataatagttgggactagttttgcaaggagggatttcaaacgatgcaacaaccattagcctaccggatgcgaccaaaaacgctgaaagacgttgtcggccagcaacaattggtcggcccaggcaagatcatcgcccggatggtcaaagccaaacgactatcatcaatgattctatacggcccaccaggtactggcaagactagtatcgcgagtgccattgccggttccaccaagtatgcttttcgcatgctgaatgcagctaccgacagtaaaaaacaacttcaaatcgtagccgaagaagccaaaatgagcgggacggtcattcttctgctggatgaaatccaccggttggataaaactaaacaagactttttattgcctcacttagaaagtggccgcatcattttgattggtgctacgaccgaaaatccatatattagcattaatccagccatccgtagtcgaacgcagatctttcaagttttcccgctcactgacgatgatattcagcacgcggtggaacgagccctcgctgacgaaaaaaacggtcttggcagttaccacgttgatttagcacccgcggccatgcaccacctgtgcaccgctaccaacggtgatttgcgcagtgcccttaatgggttagaattggccgtattatcatcgtctccggccgatgacggcaccatcgccatttcacaacaaacgattgaagaatgcttgcaaaagaaagccttatccgcagataaagatggtgacgcccactacgacgtgatctcggcctttcaaaagtccatacgcggttccgacgtaaacgctgcattacactacttagcccggctagttgaggcgggggatttaaagagtattatgcgtcggctgatggtgattgcctatgaggatattggattagctaatccagccgcgtgtgcccacaccgtcgcagctgttcaagctgccgatcaattgggatttcctgaagcacggattccgctagctgacgctgtgattgaattagccttatcgccaaagtcaaattcagggatcagtgccattgatgccgcgctcacaacggtccgtgacggccatttcggtgatatcccggccgacatcaaggatgcgcattatcaaggcgctgccaaactcggtcatggtgttggatacgattttccacacgatcacccgggtgattgggtcgctcaacagtatttaccagatgccatcaaatcagccaagtattacgagcccaaaacaaatggccgctacgaaacagcccttgcgcaacaatacgaaaaattattaaaggctaacgagagaaatcgctaacaataccttggttgtgctaataattgcaacttttatttttatatgctagactaagagtcgaaattactaaggtgtgcgcattgctctaaacaaagtgttgccgaacaattaatactactttgggatgtccgttagctaattccataacatgccttatcctttggtagttagcgaattagtcagaacgtcccacctgccttaaagcgggtcaatactgaagggcgattaacggcaccactagtttttccggaagtttacttccgttggtcaggacttgttcctggcctttttttgtggcgtgaaagcgacccaagttcacaacgtcattttactaacaccgtccaaaactcatggggagaatggttaattgggaagccggttatacatgaataatctcggctactgaaatacagtccatcacgctggtttgggtatttctgcaacaatccggcactcctgaacaattactcatcctcataaaaccagcatgacgtgtgtcgcaatcatttgacgctaaattgtgttgtgtgaactactagtactaatcgcttatctttagctagcattgcatttgtcttctcttccggaatcaactaaaataagattaacatcacctgttggaggttcattttgattacattactgcttgtcatatacacgctcattgcgggttggctcagttattatctgctgacgcaccagtcccgaccatttctcttttttgacccgaacaaagcgccgacaatcaaacacgtcgcacgctatggtggcggcttaatgttactagttaccatcgcctgtttcgtgaccatctttgttcaagcgacaatgctaattgccattgtactggctagcggttcactgattatgatggcaattgcactaattttagtgagtttcatgcaaatctcatagaaaacgctttttattttttgcgaaaacctttacaatatagttataaagtaatgaggggtgagaatgatgttacaacaataccaacacattttagttcctgttgatggttcttatgaagcggaattagcatttaaaaaggcggttgccgtcgcgaaacggaacggacctaacgcctcagttcacatggtccacgtggttgatacccgtgctttccaaaacatttctagttttgatacgaccatggttgaacaagtgaccgatactgctcaaaaaacgttggacaagtacgttgcagaagctaaggcggacggcttagataacgtggattattcgattgaatatggcgcacctaagacgattattgcgcgcgacgttcctaaggatatgggcatcgatttaattatgattggcgcaactggtctcaacgcggttgaacgcttattgatcgggtcagtcaccgaatatgtcactcggatggctgtttgtgacgttctcgttgtccggactgacttggaaaataagccagctcctaaaccaaagaaaaagtaatcttttgatacacgtacaataaaaatcggctcagtgaagttacttacctcactggccgattttttactatttgccaaaatcataccacttactgctctaaaattgcccggtaaagcgcctgaccaagatcattcatcgcgaccgtttgcgcggtacgttccccactagcagtcatcatcgtcatgataaaagttccctgacgattctgaacgatggccgcatcattttgaacaccgtatgcttgatagtccccagttttgttatagatcgtcgcgcgtgttggcagatttttgaccaacttactgtgatccgtgttcgccttcaaaatcgttaacatcgcgtgatcggctttgttcgagatcaaacgcaggttcgccagtcgtttcagcaccgttgccacattccgaaccgaagtatcgttatcatgcccggcctttagtgcggcagtatccattaaccgccgagccatttttgtatcagtcagacccaactgtgcaatttccgtgttgaccgccgagaagccgccaacacgatccaacatgatattagcagccgtattatcactctccgtaatcatgcgtttcgtgatttcagcatacgtcaactggcttccagctggtaacgtgtgcaacgtcccggttccaccaactttatcggcagcacgcagggtataacgatcctgcatgcgccaattattttgatggacctgatcaaaggcagtgaccataataaataacgtgatcaaactgccagcacgttgcgctcgattattcaaaaccacggtctggctacccgttaatggcatcaccgctaccgaagtttgaccagccaacccattcgttgcttgcgcaaccagatcagtaactgtcgtagtcggaaatgtctgtgttgccttcatcggtgcgtcagaatcgctggcagccggcttatgcacctggcttttacctgccgactcggcagttgccgatgtcgtagacgaccacaatagttgtcccacgatatagccgccacccagcaatagtaaccccgcaattaataccccaaggagtgtttgtggcctaaagcgactcgaaaaagttgtccgccgtgattgttgacgccgccgctggactcggctttgctgattgacatcaccattcactggcgttagacgatgaccacattttaggcaagtcacggcatgcggtgaattttggtaaccacagttttgacaactcatcttcacattccccccggtattaaaaataggacagtcagcggtgtgccgtgcctaatgggaaccgcaatatctcccattaagcgcggccgttcaccgctaactgtcctatcacgttatctaagcgtcgttagccacttgcaagggtgcaatatggtactcggccatttctttcgtgattttttcggtcaaactactgttatgtgtcaccagacttaacgcatacgccacgtaatagtgatcatgcgctgactggacattatttaaaacaacttcattggccgccttttgtgcatacaaacggtctaataaataaagtgactgactctcctgagccttcttgagtgccaagtcgatcaactccaaagcttcctctggaaaattgatcttagcatacaattgtgcggctgaggcgtaaatcaaaatttcattttgtaagtaatcgtcgtcacccatcggcattgcttgcgcatccattgtgtgtaaggtagcaactgcctgtttgacaaaaatttcagccttgtcataggcctgcttacgttcataagctaagccggttccaagtgtggccaggatggcaaacatatcgtgactagacttgacgaactgattaagcaacatcccaaagttaaagatggcttcgtcagcattgtcattgagcactaattgaagatagccctcatagtaataatactgtttcttatccgtattactacgtaactgcttcggacggatatgctggaacacatcctgagcctcttccagttgtgtatgtcgaatcaaagtatcaatttttttgaaggtccgatataactggtcgtcattttcaataatgacttccgataaacgaattcctaatcgattacaaattttcatcataatcttcatacttggaattttactttttttctcgattagactaatcgttgcctgagtacaaatcccatcagccagttccttctgcgacatgcccttccgctttctgaactgccgcactttttctcctaatattctcatgcttaacccctcttcattgattgccttaaaccaaactcattttgtaactccccttgctgcccccactaaatgaacaagggtatcgtgacacctaatcaatcctcgttaatccgttcgaataattgagcactaaccaattggacaataccaattacgcatataattatattcacataacggaattttagcaagaaatacgcgtaattcttatttaatattaagtttataccatgatatcggccgaaggtcatttattaattatccaggcttacagttcgttaaccaccctaatcaaggacttgttcattaaaagtgagaactactgaaagcgatttaaaggggagcgaattaaccttattaacagcaaacatcaattgtcatgacaccctcaattaatcggttgacgtggcttaataattaagattagttctcatacttctttcagtagtttataaccaactaactaaccaatttatcaattgataaaaataataatgcttagattgaccctgtaatcttcgtagttggcccggtcgatttgtgatcagcccgtcagcccccatggccgtcagtcgctgcattgcaagcggccgatcaacagtccagaagtagacgatccgatgttggcggtgggccgcactgatctgctcacgggtcgcggtcagtgcttgtaaagaataaaatcccgcgacggaattagaaaaatccgtcagataaaacggcgttatgaagccaaccggtagttgcgccgcccgttgatgtaatcgttcaatcacacgatagtccaaagagtgtaccgcccctttttgttgtatcagtcgttgtgcatagttgtcggcaaaaatccccattagttgatcagccgtcccaactgacttgatttcaactaataaaggttgctgtaatttgtgtgccaccgcaaagtactgcttaaacgtactcaagtagcctttttgaccatgctcccgtagtggtaatccactcaacttatcaacggggtactcatgaacgggaccgggttgacccgctaaagctttcagcgttggatcatgcatgacgacccagtggcgatccgctgtcggctggatatccatttcgaccatatcaggctgaacttgctttacagtccttttaagcgccgctgtggtattttggacaccgtcacgaccattaacaccccgatgtgcaataattgctagcggcgccgttggtggcgttcctagccaccagcctgcgtaaccacccaagactagcaaaccggtcaacgtaagtagcccagtttgccagttagagtgaccggcgattgctgtttctggccaaaggcgcgaccaccatcccataaacattaaccaagccagcagttgcaacccagtcatcatgaaaactgcaacaaattgactgaccagctggctaacagcgccactagcccacactatgccaccaccaatgattgccataacgagccagctaatcaggaacagccacacatttcgactttttttaaagactgtccaccaggaaatccgccaacccgttcgccaataattacgccagctggtcggagcggtcaattggcgttggagtgctggtaaccacttccagctaatcagccagcccaacagccaaagtggtcccgccacaggaagccagtcataacgcgtattaaagattatattttgaacagtcgctggcaattgtatgctcgcttgtaaagttgctaaatagcctaaccaaccgagtggtaaccaccacaccgccgtaaacattaacagcacccagcgatacaaaaattgaccggcctgccacgactcatgattactacgagcgaccatggctggtaaccaggcactcaaaagcaacaagcctagcaagctgactaccccaccgaccagaatcccgagcaccttagcgagtaccgccagcaatatgccggccaaccaccagcaggctagcggtccagccagttggcgcgctccctgcatcactaagtgccatccgcgacttaacaacctgacccctcctcacaaaaaaaggcggccgtgatgaatcgcttcatcccaaccaccacaaaactcattactatcttattccgcgtctaacgcaacgaaatcatagtgaatatcagattgacgtttgaattcatcaaaaccaagttggatcaattgatcgatcaacgccgtataactaatgcccgaaacttcccatagctttggatataaactaatgttagtaaaaccaggtaacgtattgatttcacccaagtatggttcaccatcttcagacactaagaaatcgacgcgtgccattccttttagaccaagcgctttaaacgcgtctagcgacatctgttgaatccgtttcgtcaaatcagctggtaattcgactggtaattcgaacgtcacaccactcgcatccacgaacttattattatagtcgtagaacgtgtccgtcttcggcacatcaatggcaccaagcttagatgccttaggattttcattgcctaagatcgagcattccacttcacgcggattgtcaatcgattcttcaactaaaatcttgtagtcatatttgaacgcatcggccaaaccatccaagtattcttgttcattctcagctttatgaatcccaatcgacgatccttgattggctggcttaatgaataaatgatcacccacgtgggcttgtaaataagcgtacgtcatttggtcccggttttccggtgtaaccaccacgtacttggtgttttgaatatgatgatgcgttaaaatctgcttcgtaatatccttatcaaaactagctgccgacgctaagacaccactaccaacatacggctttttcaataacttgaacagcccttgtaaagtaccatcttcccctaagttaccatgaaccactggatagaagatatcaatatctttggccagtgtcaggttcttgatgggagctaatggatcactcatgtccaactttggcatttcttcggcgacgacttgatcttctggttcaccatcaaatacgcgccgagttgcagcatcactcaagacaatcccgttcttcgtgattaaaaacaagtcaatctcgtacttattcttgtccatggcatcataaatgttgtgcgctgaacgcttcgaaacatcatgttctgaagagttaccaccaaacaacataccaacatggatctttttttgtgtctccataattttgttcatcctatcaaggtttatttcatactacggcttagttaattctacaatatctgagcacaattgaaaacatttttacaataaaacgttgttttttacgcgtcaaatggcgcagtcaagacaatcttacccaacatttgccccgtctctacgattgtgtgcgcagttcgcaaatttgctgcattaattccagctaaagtccgcttggtcgtcggtacaatcaccccggcatcggccagttgcgctacctgtgccagaatactcccctgcgtcgccatcgatggcaactgatagttagccttcgtaaacataaactcccaagcaaaattcaaacttttcggctttagtaacgccattggcaaggggtgctgatttgtcactacggcgacgatcgtgccaagtggccggactagcggtgtcactaatggcaagtattgatccgtagagtgtaatagtatcgcatgatcgacagcctgcaaaccggccgcagctaattgcgatcccagatcttgatggtaatctaagacgatatcagcacctaaccgcttaacccattcagtggtttctggcttaccagtcgtcgtaataacttgaagacccgcccactttgccaactggatggccatcgagccaaccccaccagcaccattgatgataaggacgctctgaccaagattcgcgtcagccgctgcagtgaatggtaatttttcaaacaatgcttcccaagctgtcagtgtcgttagcggcagaccagctgactgcgccggcgaccacgttttcggggcacacgcaactaaccgttcatcaaccaattgatactgagcatcactccccggccgatcgacggcgccagcataataaacgacatcatctgtcataatcgttgtcactgcttcaccgaccgccaacactttagcaacggcatcaaaacctagtattcgcggcgttgtcactggcgattgaccttgccgctgcttcgtatcgattggattgactgcggttgctaagacggctactaagatatcacggccacgaggttgatttacattaatggtgacatcttgtaaactattcggatcgctcactggcaacccttgcgttaatccaactgcttttgcctgcattcaaaagacttccttccaaaactaacctaaaaattctaattcatcatccaaataatctacgacggccgttggcagatcatcgtgtaatgcaagtgcttccaataatcgattacgattgaaaatctgcgtccattcagcttcactagccggacgagtatgcatcatcaactgctgatgccagtccttcatcgcagttaacaaataatcacaataaagctcatgtttgtttgtaatcaaggtcaaataagtcgatagtcgttctggctcgccaaaaatcaacggcgttgttaacttttgataacgagcaatcaatgcggccaacagtaataatttatccgcacgtgcgagttgagactcatctgccagttcatctaagatattgccaatatgcgtgtacgcatgcgcccaaccggtggtgcccacaaacccccgagtatccttttcgagtaaaatgtagactgtcatttgctcaacaactagatccagccgcgcgggtgtcataaacttgagacccgcatggtccgcatacaagagcactgacagtaatagtatcgcaaatgaccgctgataaatggcatcattttgcggctcatcgatgtgtgcaaataacatctgatcttgaatcaactgatcaaaaatatcgcccaactgttccggtgtgagtacctgctgctgtaatgcctcgtttaacaaatagtagacgccttgatcacgaaccagcggattcagcgaaccaacgtgtgccatcaataatttgatttgatcgtcgctcatcgcggtcaacgtgcctttcttcaactgctcatgaagtgttgcaatcagtggaagcacctcttcgtcgctcggaatcgttaccgtggttgtcacggtactcggtaactgcttaatcagcgttgccattcgactgggcagtgactgatagatttgtcccgctcgaagttgttgtcttaactttaacactgcatccttaacctgcatcaatttctctgcttgcataatgacctcgtaatctcgaatttaccttctattttagcatgtcagcgcctgtctgcccaaaagaaccattcaatcataaaacgtgacctaattatagacgtcacgaagccaacctgagccaatacccaagtccacaccgcacaccctgattaggccacgtttaatgacaagatgtttcaatccatgcttagaaaaagcttatgcttgcggtaaaacgtccacttgcgacttgataaacttcgctgacgctgctaacgacgctcgttcatcagtggtcagatctagttgaattaatgattcaatcccgtttttaccaatcacagcaggcatgccaacgtatgtcccatattgcggatcaaaagctgaaactgggcaagccagttgtgcatccgcactgacagcttctgccaatcggacaccacaagtagcaatcgcaaagtttgtataatgcttacccgccatgactgcaaatgccccttgccttgcatcttcttcaagttgatcaaggttcagacctgggaaatttttgataggctgcccattgacgctaaccgttgaccaagctacaaattgtgagttgccgtgttcgccatatacgtaccccgcaacatttttaccattcgtaccagctgcttgtccgacatacttttgcatccgcgccgtatctaagaaggtccccgtaccaaaaacccgttgccgtggaaaacctgtcattcgttgtaaataatccgtcatgacgtcacacggattcataatatcgatcaaaatacccttgaagccagatgccacaatcttgggcgcgatctcccgtacaatcgcttggtttaaatcatactcaccaaagcgacccttggaactattcatatcaatggcaccaatattgccagaagccacgatcaacacttcggcatcggccaaagctgaataatcgtttaaaataatcttagtggttgagcttagacgaggtgacgcgtcgtctaaatcgagtttttgcgccttggccaaggcctcattcttatcgattaaaactaattcatcaacggttccttgttgaaccaacgtataagccactgtcgcaccgacttggcctaacccgatcacaccatatttacgcatgctgcaaaccccaatctgtagtttatttaacttggttagcgtaccttgcaaccgctataaagtcaagcaggacgctgtctcataagaatttaatcaatagtactacttagataatatcaaacgtgcattttcattaacccgcttcggaaaattaccgtagtcaaactccgtgaaaaaagctagcctcagggaatccctgaagctagctcaatcaatcaatattctgatttaagatggtccgtttagtcggccgaaactggcaggatggcacccttgtacttcttttcaatccatttctgggtgctcttagaacgtaaagctttcattagtttcttaatagctggcttgttcttatcacccttacgaacagccacaatgttggcatatggtgaatctgatttttcaagtgcaatcgcatccttcttaggattcaacccagcttgaaccgcgtagttcgcgttaataacgaccgcgtcaccctcgttatttttgtagaatgttggcattaacttagcttcgtatgaatgtttaaacttcaaatgacgtttgttggtcttaatgtcattaaaagttgctgaagttaaatctgtcccttttttcaaagtaattaaacccgcatccttaaataacgtcaggacccgaccatagtcagccacgttgctgctgaccagaacggttgcgccgtctttcaagtcttttagactcttaactttcttggaataaacaccgattggttccaagtgaactttccccgctgatacgaggctcccattattttccttattccagttatccaagaatggaatgtgttggaagtagttggcatctaattctttcgaagccaatgccttattaggtaagacgtaatcttgaaagactttgatcttcaagttaacgccttcctttttcaattctggctgcacatgcttcaagatttgtgcgtgtggcactgaagaagcccctacagtaatggttgttgtctttgttgacgatgacttcccacaaccgactaacaaaattgccgttgccgcaactgctaataatcctagaattcccttttttttcataattccgtttcctcctatacgaactttaattaacccgtttatcaatatgccgaactgcaatatccccgataaattggaagataaacacgataatcacaatgattaccgtcgccactaatgtgatggcgttgttattggactgaaacccgtcttggtaggccaaattacccagaccaccagcaccaatggctcctgccatcgcggtgtagccaattaatgaaatcgtcgtgaccgtgattccagaaactaatgccggcatgctttctggcaataggacttttcgaataatctgccaccgggtcgcccccattgattcagcggcctcaatcactccatgatccaattcatggaaggccaattcaaccatccgcgcatagaatggcgcagcagaaataatcagtgatggtaaggccgcgcgcggtccgataatcgttccaactaacttagacgttaccggcaataatagcacgatcaaaataatgaaaggaatcgaccggaaaacgttgacgaacagcgcaacaatccaattcaaggccttagccagcggattctgactcccagccgtctcataaagtaacagacctaaggcgattccgagaatggcaactacgaccatcgacacaatcgtcaaccaaattgtttcccacgtggccgacatcatgctaccccaatcgacatttgcaaatttaaaatatgaatctaatccttgatcattcacggttcaagacctccgtttccacccgcatcgtttgtaggtacgctagagcgcccttaatctgttcctgatcacccgttagttgtaagtacagcgaaccaatcgccccttcttgggtttggtgaatcccaccctcaataatatttaaatctaacggatacttcttcaacatctctgaaacaatcggtagctgggcttgatcgccatggaacgtcagttgtacgatggttccctttggatatttcgccagcagctggtccacgaccaccgttgtgtcattcagcgacggtgtgacctcttcattaacaaaccgcttagtcacagcctgctgtggtcgcttgaagacttcaagtactggtccttgttcgacgattttaccagcttccatcaccgcgacatgatcagcaatcttgcgaatcacgtgcatctcatgcgtaatcaatacgatcgtcaaatggagcttctggttgatcgataacaacagatccaacacttcatcagttgtctgcgggtctagggcactagtggcttcatcagaaagtaaaatctgaggatcattcgcaagtgcccgggcaatcccgactcgttgcttctgaccacctgataattctgacggataagccgtttcccgaccggccaacccaaccaagtctgctaagtgttcggctttcttacgggcatccaccttggacagaccagcaatttcaagtggaaacataatgttctccaaaacggtccgcgaccataatagattaaaatgttgaaaaatcatgccgatcttttgacgttgggcgcgtaacttggccccgctcaacgttgtaatattgacatcatcaatcacaactgacccactagtgggtgtctctaagccattcagcatccgtaccagagtacttttaccagcacccgaatagccaacaatgccataaatgtgaccatcttcgatttttaaattaacatcttgaacggcgtgaaccgccccttgcttagcatcaaaggttttcgtcacatctttaaattcaatcaagtcaattcctccttacgcatcaaaaaaagctcctcatcccagacaattacgacaataatcatcaataggacgagaagcttagcctcgtggtaccacccatcttcacaactagctcacgccagttgtctcaagagttactttgaactccgcatgataatgggtgcgacccaagcttagcttgcgactgctcactaaacttcattacttcaagaccatcttcagcttcacgattaatcccctttcaccaatcagggactctctaagtaatcataaccgcgtactcatcttttcaaaatgataacttttttaatcaattgttaatgtaacgagtataccgagcctgtttctaattgtcaaggcctggcaattagtccacgtcgattaaccaagcaacgccgtcttcaacgctatttaacgcatcgaagttctcactcaacgccgggttgaccgcaaccacggtcccattgattggacagttgaattcagaaacggctttggtcgcttcaacgctcagaaaagcgctgttctgactgaccttgtcaccgatagctggtaactcagcatatttcacttcaccaagagcctcatgggcggccttagttaaacctaaccgcgtatgtccatcaacgtcttttgtccaaaaataagctgcatcttcactcatactaaacaccatacctttacaataattttactattcaaaccggtcgttacgactgaacatgtaggacttgtaatgatatcgcatcgacatcattaaacctatcccagccatattggcaatcaacgccgaacccccttgactaataaacggcaagggaatcccagtcattggtaacagtccgatactcatcccaatattttcgaacacgtggaagagaatcatcataatgaccccggttgaaatgtaagcgtagaattcgttcttcgtatcaaacgtcactcggatcatctggtaaatcaataagaaatacaataaaatgaccacggcacaaccgataaagccaaagttttcaccaattaccgagaaaatcatatcagattcacgcacaggaacagtcacgtgggaaacgttaaatccccgcccagtaatctgacctgaaccaatcgctttcatactctgccaaacttgataagcattgttagacgtgtccgtcgacggattcaaccacgtatcgatccgcgcaaattggtattgcttaaaaccgatagcttccaaaatatggcgaccactctgcgagatcacgagatataacgcagtccccgcaatcgccgccacaatggcaaacgtcggtgccaataatcgccacgaaatcccagaaactaagataacgcccccaagaatcgcgaagaacaccagcatcgtcccaaagtcattttgtaacttcaaaaggatagcaactggcaccatgtacgcaattaacttcccaatgagttgccaatcgctcgccatcgtatgtgttgggtgctccgtgttatgcattgtcacgactcgtccaagcatcaagatgaaggcgggcttcatgacttcagacggttgcaacgtcaaggaaccaactgcgaaccaacttttagccccagtgctcgcaaacagtgatctactgtacaagaccaaaacggccgcaagcaggaagatcccaaaccaataggcaatcggtgccactcgccataactgttccgaatcaaattgcatcacaattacggcaatcgcggtcccaatcacgaaccacatgacttgagaaatcacctgcttcgtgacgtttactgaactagagtcgtgcactgcggcgacataaatcgacgccagcccgatcaatcctagcatcatcactgaaaatatgataccccagtcaattcttgaatcctcgtcttgactgcggagtctagattcttctgccacaaataacgctcctaacctgttgggattagcccaccgcacgcgtcagactaaccctattcacaatatcattttgtactttaagatagtttttattatacaacaacctggtgccgaattctcggaaccaggttgaaggtttactaaaaattagcctttgtgtagatggtaagccgacaagatctcttgcagactctcatcaaaagatttggtatgcgcaaatggttggttgtcactaaccatttcagcttcaaatcgttcaccgacttgagtcacttgtccaatcacttgtttaccgatcaaaacttcggtaactggttgaccgttgaccttagtttcgtttaaagtgaccgaaatcgtcttatcttttcttgccacggtggtcttcctccttgtattgcggattacgacgcaatgaaaaatgggctggtaccggatcaaagccgcccttaactaagggctgacaacgtaagatacgtgcaactcccattagaacgcctttaactgcgccaaaccgatcgatcgcttctaacgtgtaattagaacaggttggataatagcgacaatgagccggactaaacgcagaaaaggcccgctgataaaagcggatgcctttcattaataaccgtcgcatcgtaatttatttcttgttcttagcagttttctgcatatgttcaagtaaaattccagccccctgagcaacgttgttcaatgggtgttcggcaaccattacgggcacctttaagttttcactgatcaattgatcgaggccactcaacagtgcgccaccaccagtcaacgtaattccacggtcaataatatcggccgcaatttctggtggtaaagtttccatcacgtgatgggccgtgctaacgatctgcatcagcgtttcgtgaatagcttcttcaacttgattggagtcaatgtcaattgagcgcggcatccccgtcacagtatctcgaccacgaacttgggtgaccttatcatcatcgccgtcctgcttgaaaacttgtgcgatttgaatcttaacttgttctgcactgcgttcaccgatcaacaagtgatgttgatctttgacgtagttcacgatgtcctgattcatccggtcgccggccattcgtaacgaactacttgccacaatgtcacctaatgataggacagcgatatcactagtcccaccaccaatatcaatgaccatgttcccacgtggttggaaaatatccatccctgcgccaatagccgccacttttggttcaacttccaagtaaaccttgttaccgccagatttttcagcagcttgcaagattgccttgcgttcaatttcagtagtgttcgttggggtacagatcatgatacttggccgcgacataatgccacggacatttaattttttaataaaataggacagcatttcttcggtgacatcaaaatccgaaattactccgtcttttaatggtcgaattgcccgaatgttactaggcgtttttccaaccatttggtaggcttcggacccgactgccaacacttgattcgtgttcgtatcgatagcgaccacggatggttcgttaaggacgatgcccttacccgatacgtaaattaaaacattggcagtacctaagtcaataccaatatctaaagccatgtttttgctcctctcaaacatacaattatacgagtaatcattataccatactctacagttgatgagaactgacggctgtcctagccactcgttcatttgtcactaccaatcaattggctgtgcctaatcatcctgtcgtttcgaccactcatcgaccgtcagcgaataaattgcttcatcacgatattgaccatttaacaagatattttctggcagggtcgcatccaaatgatattggcgtcgctcagcaacagcccgacttgcctggttggcaacgtctgcacctaagatgaccttgtgcagatcaagctccgtaaaagcaatttcttctaatcgttcgagcgctttagtcatgacgccacgaccagtatatttctggcccagccagtagccaatctcaccgttgtgattaatggcactaatattatgcaagtctagcatcccagcgacttcgccatccacaatgatggtggtgataaacacctgtccatgagcctgcttggtcaacattgattcgataaaatgacgctcgtcttgcacggtcgccgtcgcatcaacccacggcatccataacttcaaatggtcgcgattatgatcaactaagtcgaaaagcggctccgcgtcagccacttcagtcggtttcaatgaaatgtgtttgtcgataatattaataaacataagctgtcctcctgaatgttggcgccgggttaccccgcttcgccacaaaaaagccttcaaaaacgagtttatcgcactttgaaggttttgtaagcatttatttcgatttattccgcagcttcgttcgcaaaatcaggattcaacgcataaacggtgccatcgggaacatcaactcgtttaatctcagcacctaatttagccagcttaccatggaagttaaagtagccccgatcaagatacttcaaattagtcacttcagtgtaaccccgactgaccagtccagcgattactaacgctgcagctgcccgaagatccgtcgcagtgacctgggccccgttaaagtcagtgggaccatacataatgacggagcgcccttcaactttgaagtcggcgttcattcgccgtaactcatcaagatgcatgaagcgattctcaaaaaccgtttcagttaataaactagtgccctgcgcacacaactgcaaaattgtcatttgtggttgcatatccgttgggaaacccggatggggcatcgtcttaacggaggttggcttcaagatttctggaccaataacccgaataccagccggttcttccgttactgtgacgcccatctcacgcatcttcgagatcaatggcttattatgttcggcaatagcatcctcaaccaagacgtttccctgagtcaccgcagcagcgaccatgaatgtcccagcttcaatccgatcctgaacgatactatggtcacagccatgcatcgctttaaccccttcaatgcggatcgtttcagtaccggccccggtaaccttagcgcccatctgattcaaatagttcgctaggtccacaatttcaggttcacgagcgacgttttccatcgtcgtgatgccatctgcaagtgttgccgccatcattatgttctgcgttgccccaacacttggaaaatctaagtaaatggccgctccgtgtaactggttcgcggttgcttcaacatagccatcgcggcgttcgatttcagcaccaagcgcgttcagtccctttaagtgtaaatcgattggtcgtgaaccaatcgcacagccacctggcatcgcgactttcgcatggcctaatcgtgctaatagtggtcccatgaccacgattgaagcacgcattttggatacgtattgaaatggtgcttcggatgataattgacgactagcgtcaatatcaattgttttattaatttcatcaaaatcaattttagtattcaaaaatttcaagacgttgttcattgtaaaaacgtctgataacactggtacatttgataaatgtgtctgaccagaactagccaacaagcttgcggctaagattggtaacacggcatttttagcgccctcaatatggacatttcctgtcaaacgttgaccgccatgaactacaatttcctccatggataaaccctccatcactaaacgataatcaacaaacaagttacgtgagatttcggattgcgtaaaaagcacacttactaaaagaacccgattggatcagatgcctcgcacctgcccaaattccactgttcaccgctgtactaagcaaatcggcaacgcgcggtgtgcaatccaaacaccagctcaaccatcaaaacaacctggacacaccatggcaacttgccaatagcagcatgcaggttcaaatcggttcctaatcatcataccatagaacactagtggataaatattacattttacattttcgttacaatttcaacacaaatattaaatacttatgattagttaactaattagaagtccgtcgtgcaattatttgacaagccatacccatattgattagcagtatcgttcgtttgtaatcgttttctttattgtaatctcactataatttgcattctaccattccacttatcgcaatgcccctaatacgctcaatcgattagtaaaatctagttcacgaacatccgcgccgactggacaaaacatttcaacgtcgcgataaaattggccactgaaacgtttaagttcgatgtaaacttagttgttcatgttccctatgccgacctttggaaattgctgccaattgtcggaatgtgatgatcacccatttaagtcgcgatccacgtcttaattactgctctgccagatactgatgcaatgttggcgaaaaatattcgaatcagaccgattcttctagttaacaacgcgatatcgccattagtaagccagtgcttggcccttgatcaacccacggttccaatctgctttgaaccgtgcaagcttaaaactggacagtaacgggtacgactcaccgcggtaagtttgactaacttgtgcatcgcggcttaactgaaccgcacaaaaaaagcacccgcaaataattgcagatacttttcagaattttaagttgttaatgccgagcaacattcaaacggttcatggcacgccgcaaagcgacttgggcccgcgccaactcagcatcatcgtgcttttgttgggcattttgaatccgtgtttcagcgcgtttccgtgcattttcagctcgagcaacgtcaatgtcattctgacgttcagcactatcggcaacaatcgttgccgtattattactgaactcaacaaaaccaccattaacggcaatttcgtcatcttcctgatcactttcaagttgcttgatccgaacctcatcgattgcaagcgatgcaatcacaggaatatggttcggcaaaattccgagttcgccgtcaatcgttcgcacgatcaacattggcgtcttattctcatagacctgaccgtctggagttacgatgctaacggttaatgattttgcattgtcagccatgtaaacccctcctaatcagttaccatcgatttcgctttttcgaccacgtcgtcgatcttaccaacttgacggaatgcgtcttctggtaggtcatcatatttaccttcaagaatttctttgaagcccttgatggtatcgttgattggcacatacgaaccaggttggcccgtaaagttttcggcaacgaagaagttttgtgacaagaagaattgaatccgccgtgcacgcgcaacagttgtcttttcttcgtcagataattcatccatccctaaaatcgagataatatcttgcaattcacgataacgttgcaagacccgttgaacttccgttgcaacttgataatgttcttcacccacgattgatgggtccagagcgattgaagaagaagctaatgggtcaacggctgggtagatcccttgttccgtcaaagaacgttccaagttggtcgtcgcatccaaatgggcgaaagtcgttgcaggtgccgggtcggtataatcatcggcaggtacataaacggcttgaatcgaagtaactgaccccttcttggtagaagtgatccgttcttgtaattgacccatttcagtggctaaggttggttggtaaccaacggctgaaggaatccgaccaagtaaggcggaaacttcagaaccagcttgcgtgaaccggaagatattgtcgatgaataacaacacgtcttgaccttgaacatcacggaagtattccgcaatcgtcaaaccggtcaaggccacccgcatccgggcaccaggtggttcgttcatttgaccataaaccatggcggtattcttcaaaacgccggaagccttcatttcgaagtaaaggtcattcccttcacgcgtccgttcaccaacaccggtaaacacggaaatcccgttatgttcttgggcaatgttatgaattaattcctggattaaaacagttttaccaacaccggcaccaccgaacaacccaatcttaccaccacgaacataaggtgctaagaggtcaataactttaattccagtttccaatacttcagtactggtcgttaattcatcatatttaggcgcatcccgatgaatcgggttacgttctgcgtctggaccgaattctggaccaccatcaatggtttcccctaaaacgttgaagacccggcctaacgtctctttaccaacgggaacagtaattgaagaaccagtgtcttcaactgtcattccccggcgcaagccatccgtaccatccatcgcgacggtccgaacaaccccatcacctaattccaacgatacttccaccgttaaagtgtcatcgttgtccttctgaatgatcaaggcgttattaatatcgggtaacttatcgtttagagagaattcaacgtcaacaacgggtccaataacttgtacaactttacctgtactcattagtcgttaattcctcccacttcgttattcttgcgcaaccaaaccaccagtgatttcagtgatttcagtggtaatagcagcttgacgcgcgcggttatatttcagatttaatttatcgattaaatcgccagcgttatctgatgcagccttcatcgcggttgacgacgaagcatgttcagcagtcttggcatccaagattgcaccataaaccaagctttcagcatattgtggcaacacggccgacaaaatggcttcttctgacggttccatttcatactcgggaccgacatctacccggctatccttggctttacgattatctgactcactttgttcaaaggtctcttcggagatcggtaacatcttaacggcccgaaaaccagaagagagccgattaataaagtggttgtagaagacgtaaagttcatcaaagacttcgttgtggtacattgatgtgactgtcttaacgatttcacgaacctctttaaaagttgggacatcagagacgccgcggtactcataagccacgtttaacccgttctttttatagaaatccgcaccagtgccaccaaccgccaaaacgactgcgttatcggcatcaaccttgtgcgtccgcatgaaatcgttagtctgtttcaacacgttactgttgtaactaccaacgaggccacggtccgaagtgatcaccaataaaccagtctttttaacggggcgttgcgcgagcaattcactaactgaaatcgtattcgaattactgttagcaacaccggcacttgctgacatcagatgagctttggcaagatgtgaaacgatgctttcaactttagaagcgtacacctgatacgtgctggtatgcttttgaatctggttcaattttgaagttgagaccatttgcattgccgacgtaatttgatgagtcttctttgttgagtcaattcggcgcttgacatccattaatgattctgccatgcactactcaccatccttttcagccataactacttcgcagcggcagcggttggctggaattgttctgcaaacgcatctaaggccccattcatcttatcagcttctggtaacttcttggttgccaaaatcgtatcaaagaggtcctgatgactagcatgaataaattcaaacaattcactttggtaacgggcaatatcatcaactgccactttatccaaataaccgttggtcaaagcatataaaatcattacttgttcttcgaccttcaatggtgaatgaacaggttgttttaagacttcaacgatccgttgcccacgatttaatttcgcttgggttgcagcatccaagtcagaaccgaattgtgagaaggattccaattcacgataagaagccaagtcaagacgcaaggtcccggcaacggacttcatcgctttaatttgcgcatccccaccaacccgggaaacagaggccccggcatcaatcgctggccgcacacctgaatagaatgaatcactatccaagaagatttgcccatcggtgattgaaataacgttagttggaatataagccgaaatatccccagcttgcgtttcgataattggtaaggccgtcattgaaccgccacccaattcatcgctcaacttggcagcccgttcgagtaaccgtgagtgcaagtagaagacatccccaggataagcttcacgacctggaggacgacggaggatcaaggaaagttcacggtaagccgttgcttgctttgaaaggtcatcatagacgatcaaaacgtgcttgccgttcatcataaattcttcacccatcgctgccccagcataaggagctaagtacagtaatggcgctggttcagcaggtccggcagttacaacgattgtgtagtccatcgcacctaacttcttcaacgtttcaacttgggcccgtacagttgagtccttttgaccgattgcaacgtagacacaaatcatgtcttggtccttttggttcaaaatggcatcaatggcaacggacgtcttcccagtcttacggtcaccgataatcaattcacgttggccccgaccaattggaactaaggcatcaatggccttgatcccagtttgaagtggttcgctaactgattgccgttgcataataccaggagctttatgttcgattggccgcgtattcgtggtcttaatctcacctaaaccgtcaactggttgacctaatgggttaacgacccggccaatcatggcgtcaccgactggaacttccatgatgcggccagtccgcttaacagtatcgccttcacgaataccatcaaaatcccctaaaacaacgataccaacatcgttgctttcgaggttttgtaccatcccgtaaactccgttactgaattcgagtaattcaccttgtaaggcgttgtcgagtccgtgagcacgggcgatcccatcaccaacgtaggtgacagtaccggtttcagcaactgagagctcagtttgataactttctaattgttgtttgattagagcactgatttcttcagatttaatgctcataaaagtttcacctcttcgtaaactaattgttgatgagtgctcgtcttaaattcgttagttgtaacgcaacgctaccatcaaacgtttgattatttgacttcacaattacaccgccaatgattgcttcatcgactttacgtgacaaaacaacctgattggcaccaacacgtttggcgaatgcctttgcgattgcatcagcttgctcatctgacaacttgaccgcagacgttacttcggcatgcactattttgcgactctcatcgaaacgtgcttcaaacgcgtcaacaatgccaactaagttcgacatgcggccgtaatcatacaacatttgaataaagtttttaatgtattctgaagcgtggtcagtcaaagttgacaacgttgtctgtttttgatcaaccggaagcaatgatcctgagaggacctctgccaattgcgggttgtcgacaaagacttgccgtaattgctttaactcggccaggaatgcttcggtctgatctttttcaactgcaagttcaaagagtgcctttgaataacgacttgcaattgtaagattatcaagactcatgctttcccaacccttcaatatacgaattaattaatgcctgttggccttccggatccaattgcttcttaataatcttcgtagcaatcgcaaccgaaatgtcagcgacgtctgattggacgttcttcaaggcatcttgacgctcctgttcaatatccttacgcgcattttgtttatactgcgttgcttcgttttgcgcatcggcaacgatacttgaccgttgcttttcgccactctttttcgcgtcagcgacaatttcactcgcttcagcgcgagagtgtgatagcgcatcacgccgttgatcagctaagtcactcgcttcttgccgtgacttttgtgctgaatcaatgtcgttcgcaatcttgtcagctcgatcagccatcatttttgtgatgggcttccaagcaacaacagagatcaatgccatcaaaacaataaagctaatcccgataaacaacatatcaccaaggtagagaccggatgcaccgataattaaatgcgagagcatctaatgacacctccttctttcattttcattaaaatgaactcgttgaccaatgattacttgttcataaccatcaaagcaacaacgaaggaaatgataggcattgattcgatcaacccaacaccgatgaacatgttagtccgtaattgaccagataattctggttgacgggccatcccttcaagcatcttagaaataaccaaaccgttaccaataccagcacctaaagcggcaccaaacatagcaatacctgcagcaattgctcccataatctgtgtatcctccttaaaattaaaaaactagaaattattcctcgtcgttaaccttctgagaaatataaactgaagtcaaggttacgaacacgaacgcttgaatgctcccgataaacactgagaaaccttgccataagagttcaattggaaatgagtaaacatagctcaaccaaccgttgctctttgccaaatcagcaaccttcgttagtaacatttcaccagcaaagatgttcccgaacagccgaagacctaaagttaggaaatcggtaaattgttcaaagacgttaataaccgagaaaacagcaaaaggttgtgtgtattctttcaaataaccacccatacctttcttacgaacacccgcagcatgtgcaagtgcaacggtcataaacgataacgtcaaagtcacaatcggatcggcggttggactcttcagatacgtatactgcccgacctgaacgtgaatgaacaatccaagttggttagcgatgaagataaagagaaacaatgtaaatgcgtacaaaccgaagttagacgcttcgttacccttgatcgaccctttgacaatgccattcgtgaactcgatgagccactccagcacattttgtccacccttgggcttcattgttaaatgtcgcgaaagtaaaaaaacaaacaagaaaacaatcagacaagtcacaattactgagatgtcattcgcgatattaaacgtcagtccaaggaatttgactgtaggaactggatcacccactgaatatcacctctttcctttaatttcggtgctacgataaccttaacctttgagctagtcaacgtcaattttatcgtaacctgaaatggtagattagagacacccctaatcaaaatacaaaggtaataataccaccaccgtcgaaaaaattcaaaataatttcaacatttcgtcaatcaataaaaatccaacaatatcaagctttcattaagctttcaaatcgttggattttcattattttgactttattttcattcttggcacgcgcaatgacggcctacttctcatttaccgccgtctttggcaacaccaagttcatcacaattccgagcaccgttgcaactgctagaccactgaactgaaagcttcccagttgtaaataggcattgccaattccaatgaccaaaatcgctgatgcaatcattaaatttcgcttctgattaaaatcaactttattatcaatcagaattcgcatcccacttgaagcaattaccccaaacagtagaaagctgaccccaccgatgacgggtgatggaatactctcgatcaacgcggataacttacccacaaaactaaagacgatggcaaaaaaggcggccccaccgagcacataaatactgtggacccgcgtaattgccagcaccccaatattttcaccataggaggtcacgggtggtccaccgacaaagccggcgataatcgaggctgtcccgtcgccagccaatgtatggttcaaacctggatccttgaagaaattccgcttagtcaacttattgagtaccataatatggcccatatgttctgacatcgtcacaaaggcgattggtgccatactcagaatcgcgccccaataaatgccaggatgataactaataaaaggcaattgaaaggcgggcatcgcaaaccactgcgctttttccacaccagaaaagtcaacgattccaactaacacggcaatgatatacccacagacgattcccaacaatatcggtactaaactcataaatccacgcaagtacatgttaaaaatgacggtcagtaacatcgtcgccatcgcgacgccgaaatatttaatatcataactactcccgttcattgttgcgtccttagctgccgtccctgcgagtgacaacccaattaccatcacaatcggccccacgacgatcgggggaagcgccttatcgatccagtcagaaccaattaaagtaactaataaactaactagcaggtacacacagcccaccgcgacagtcccctgagcgatggccggatatcctgcggtcttcatcagagactgcatcacaacgataaatgaaaagctcgagcccatatacgccggaatctttccgcgcgtgatgaggatatacattagcgtcccaacaccagagctaaacagcgcaatacctggatttaatcccaccaggattggcaccaataccgtggaaccaaacatcgagaacagatgttgcaccgacaagcctaaccaactacctaattttggtcggtcatgaatatctaacacgacttcatcattatgaaacgccgctttctttgtcataacgcacccctttttatgaatgattgcaaaagaaaagacagcccaccactcaaagcggctaggctgtccgaaattacgcacggcttccttgaaagcgtacgtccgttcatccttttcagcctctctgagctaatttaaaggaactgtttaattgcaattagtctactcgtctccgaaataattgtcaactcaatgtttgaaccgaaccagtaacagcccctaaaaacgatattagttcaaaacatcataatatttgcgacaacattcctgaaataatgtgactttctcacccaacgttaccgaatattcgaccaatacagtgtaatcgccatctaaaacaccctaattatccagtgtcccccaacagttaatgtcaataactacctataatatacgcgttgtacaaattattatttggcattaacggtgattaaaacgtgctaattagattattgcacgtcagccggtgtgggtcctatgccgacctccggggnnnnnnnnnnagccggaagcagaccacttccagctaagaataatttggctactgagcattgtcacccaagcccctccggtcggtaagccgctcgaatggctgatgaacggccacttaacttggtacaatttgtcgctgactattttgatactggaactttaaacaaagcgttaggtgcattagcactttgtcaagagattaaatcttactacaccaattcaggattagtgagctatctcaatatcattttcagtctgccagttgattgacaaaattactggttgtaaaaagcaacgacaaattcatcaaaagttaggtacatcttcgtcagccattcgaacactgtcacgactggaagtcggcttaggacgaaccagcaaagcatgtttacgcccacttacacccgtttccagtggtccatagctggctgcttttaatcttagaaattagcacgttttagtcacgattcatgactaatgaactcacagaatgcggatgattatagctaaagttgttaataattttggaaaacaaaaaggtagccccccagacattgcctggcggtgctaccttttgtcaatgcaacttacttcgtaccaaataaccggtcgcccgcatcgcccaaaccaggaacgatgtagccatcttcatttaaatggtcatcaagtgctgccgtgtaaacgtcgatgtctggatgtgcgtcccgaagtgccttaacaccctcaggcgccgcaactaaacacataaacttaatattacttgcgccgcgctttttcaacatatccatcgccatgatggctgaaccaccagtggctaacattggatcaacgacaaataattgccgttgtgaaatatcacttggtaatttaacgaaatattcgaccggcttcaaggtcttttcatcccgatacatcccaacgtgcccaactttagctgccggaatcatgtttaagaaaccgtcaaccatccctaagccagcccgtaagattggtacaatggcgactttcttacctgccaacgttttttgcgttgacttggcaatcggtgtttcaatctcaatgtccttcaacggcatatcgcgtgatacttcgtacgccatcaacgttgaaatttcgttaaccatttcccggaagaccttagtaccacagttcttttcccgaatgatcgtcaatttatgttgaatgagcggatgatccaaaacctcaaacttacccatgttgctacgcacactccttagtgatttctttctattgtagctaatttagagagaaaaaaccagacctgatataaattacttaatcaacatcgatcgggtgcttcgctgttaaagccattgcttgctgtttaacgtcatctagatttgcttgatctgtcggtgcttgtaacgcttgcaaaatcaattcagcgaccttagttgcatcagcttcgtcaaaaccacgggtcgtaatcgcaggtgttcccaaccgaataccagaggtcttgaaagcccctaacgtctcattcggaatcgcttctttgttgaccgtaatataaaccgtatctaacagatcttgtacttggcgaccgttcaaaccagacttagtgacatcaatcgtcattaaatgattgtccgtgccaccagaaataacccgaaccaagtcagagtcattgaagaccttcgccattgccttggcattatcaatgatatgttgggcataaaccttaaactcaggctgtaagtcttcgcccaaagcaatcgctttacccgcaattacgtgatccaacggcccaccctgattgccagggaaaacggctgagttgatcttcttgccatacttttctttcgctaaaatcataccgccacggggcccccgtaacgttttgtgcgtcgttgtcgtaaccacatcagcatatggcactggattaggatgtagcccggccgcaactaagccggcaatatgagccatatcaaccatcaataaggccccaacttgatctgcaatctcgcgaaacttcttgaaatcaatcaatcgactataagcagaagcccccgcaacgattaactttggttgaaaatcttgtgcttgtgcaagaattgcatcatagtttaattcttcggtttcaggatcgagcccataaccttgaaaatcgtaaagtttaccagagaagttcacactagatccatgtgttaagtgtcccccagcatctagtgacatccccatcacccggtcaccaggttgaatcagtgccatatatgcagccgcattggcttgggaaccagagtgtggttgcacattagcatattccgcaccaaataatttcttagcccgttcaatggctaaggtttccacttggtcaatgtattcgttaccaccgtaaaagcggtgacccggatagccttcagagtatttattggtcagcacactcccctgcgctgcccggacaccctttgaaacgatgttctcagaagcaatcaactcaatattatgttgttgccgtgcctgttccttactaatcgcagcccatacttctggatcttgttcctggtaattcatgaataaatctcctccatttcgcaagtgacaactttcgggttttcccgacttgcaatcattatacactaaaatgagtctgaccggcagatttatttaatcggttcatgtaggcaagcccaagtcctttattttcaaaggcttggcacagaatatctttaatttccgtctcagtatcaaagtgccgcaagcccgcgaacagctcccgacttgccgattgaatatcttctccaagcgaaaattgttcgcaattagccggaatttgattgttagttaaaatatcatctgttgccataacgcccattggcacatcttgctgggctgcccacgccagcgcttctggccaatcttccgaacgatcaacgatataaacttgtgcgtttggcgcatagtgcttatatttcatccccggcgccttaggaacttccttagctccgacatggtgcaattcggtttgaactggcatgccaatgacccgttcgattgcttcaggcgttacggcaccgggccgtagaattgctggttggtcggttgaaagatccagaactgtagattcaacgccaaccttcgtcggaccatcatccagaataccagcaattttaccacgtagatcatgcaatacgtgctgcgccgtcgtcggactcggcttaccagatgtattagcggatggtcccacgataggcgttccggcagcacgaatcaaagccagggttgcctcattatcaggattacggaaagccgccgtctgcagcccaccagtaacttctggtgccaacgcatctggtttcaatttaaaaatcatcgtcagggggcctggccaaaacgccttaatcagcttcttggctgcttccgataacggttgagcaaaccgctcaacggtttccacatcagcaacatgcacgatcaaaggattatcactcgggcggcctttagctaagtacacttgcttaacagcatccacatttgtcgcatcggcacctagcccatagaccgtctccgttgggaatgccactaactgccccgcagttaacaacgccgcagcggccggaatctccgccggcgtatatactttcgtttccataatatattcaaacctctactttattattaattcatcgttactttcatataatattatttattatttacatcacggacttaatcaattgctcataaattcacgccgtacctcccaggttaaaaacagcccgcttaggataagactcacatttgagataacgcgggttatgcgcgagctcaaatcgacgactgcgttcacccacccccgaaggccggaatgggacgcggattacaaacagcaatctacctaatcggcccgcttttatcagcattctccaggataacgcgcaactattgccgagtcagagtcattgcaactcgcagcatccgatcgtgacccgccatgtcttgtcgcagcgtcacggtcgcgtcgggcatcgactgcgcgaaaagcgtctgcaaggccggtccctgatggtagccgaattccaagtataagcgaccggtcgaagtcagatgatcggcaaccgtcgtcgctaactgctcgtaaagtgccaacccatcgtggtcagcaaataaggccgtttgtggctcgtgggcgaggacgctggcgtccatgacgtctttttcgctcgcagcgatgtatggcggattactgacaataatatcaaacggctgcgcagatacgctggtcaatagatcactgtgaaccagcttaacatctaaatgtaggcggtccgcattggctttggcaacttgcagcgcagcggttgaaatgtcgctggccgtaatctcccatgccggccgttcgtgtttgattgccaatgcaatggcgcccgagccggtaccaacgtctaagagtcgaactggcgctgtcgctgggacatccgtcaaaatccagtctaccaattcttctgtttcgactctaggaataagcactgctggatcaacttgtaacgtgagtccataaaacggtgcgtctccgagtacgtactgcactggctcaccagcaacaacccggtcaatcccctgctgataagcatgccaaacagcactgggtagcggctcgcggtaacgaatgagtaattgtgtctggtctagccgactcaagcccaataacaggaagcgagcactatcagtcggcaactgggccgtttttagacaaaaagaagcccactgctgggcttcaaaataagtgggttgagtgggcttattcattagttaagcgctccattttttcagcttgatcagctaaaacgagggcatcaataacttcgtctaactcgccgttcatcacccggtcaagtttgttgagcgttaacccaattcgatgatccgtcacccgattttgtggaaaattgtaagtccgaatacgttcagaacggtcacccgtcccaacggctgatttacgttcagcatcatattcgttttgttcccgtgactgatagtagtcgtagacccgtgcccgcaagatttccatcgctttggcccggttttgctgttgcgaacgttggtcttgcatcgagaccacgataccggttggtaagtgggtcatccgcaccgctgaagacgtcttgttgatatgctgaccaccagcaccagatgaacgaaagacatcggtccgaatatctttttgatcaatatcaatgtcaacatcctgcgcttccggcataacgccgactgttgcagttgaggtatgaacccgcccagctgattcagtcactggcacccgctgtacccggtgcgcgccactctcatacttcagcttagagtagaccttgtcaccagaaatgatcagaacgatttctttaaagccaccaacttcagtttcattacgatcagccacttctacttgccagccttgacgttctgcgtacttcgagtacatgttgaacaggtccgcagcaaacaaactagcttcgtcaccaccagcagcaccgtgaatttccatgatgatgttcttgtcatcgttagggtctttaggcaacatcaataacgtgatttcatgttccaattgatccttttccgcgttaaggttctttaaatcatctttgaccatcgcgttcatctcatcgtcgagcttttcatgaagcaattcgtcattttcttcgatctgactcgtgacttccttgtagtgattatatttttcaaccgtttcacgaatattacccatttccttagataacttcatgaaacgttgagaatccgaaataacttccggatcacttaatagttcaccgagttcctcataccgatcggcaacggcttgtaacttatcaaaaaacttatccattctcagttaaccctcactttgttaatttcggcgggtaaaaataatgatgacgacaaactgggtagtacgcctcattacccccgatttgaacttgttcgccttcataaacgggctgaccatcgtggaaccgtaaattcataattgcttttttacgacagaaccagcagatcgtcttcatttcttcgatcttgtccgcatatagcagtaggtacttgctaccttcaaacaattcgttacgaaaatcattctttaaaccaaacgtcattactggaatctttagctcatcaacaatgtcagccaattctaggacgtgatgctttttcaaaaattgggcttcgtcgattaaaacgcacgcagcatccggattcgtttgtttaacgatctcaaaaatattggtatcatcaaatactggcgttgcttcacgtttaaggccaatgcgactcgcaacatagcccacaccatcacgattatctaagccactcgttaagataatgaccgacttatcttgttcctcatagttatgggcaactttcaaaatttcaatggttttaccactgttcatcgcgccatatcgaaaaaataactgtgccaagcgactcattccccttttttacacatttctagtcaattatagcggatttggccgtgaatttcagcattctgtcattaaaactaattaacgaattgataatatgcggttaaatggcgggagtatcacttttcttttagggacgttcagtataaaatacttgagagtaggacattttgtccggtaattatgattttaatacccggtagttggtcacactgatcatttcccaggtaaatcaagaattaggggtaccgataacttatgtcaattaatagtacattagccacctggacgggtaaatccgcatattggtttttacacaccttccgtggcggtgggagctcactccccggcaagttagcgctgaagctcgatccaacgattttaaagcatctcgctaaaaactacgacgtcatcgtcatcactgggaccaacggtaaaacgttaacgaccgccttgacggtcaaggttttacgtgaacagtaccctgacattttaaccaatccaagtggatccaacatgaagcaaggtatcgtcacgacctttttacgggcacctaaagcgcaccaaaagccactcgcagttctagaagtcgacgaagctaacgtaatcatggtcaccaagtacatcacgccaaaagcctttgtcttcacgaacattttccgtgaccagatggatcgatatggtgaaatctacacgacatatcaaaaaatcttagacggggttgctttagcacctgaagcgacaattattgccaacggtgatttgccactcttcaatgccaaacaattgcctaatccgatactgtattacggatttgactaccagcccgaccatgaccaacaagcgccagcaaatacggatggcctgctttgtccgcgttgtcagcatattttacgttaccatagtcgaacttatagcaatatgggcaagtattactgtccccactgcggttttgagcgtccacagttggcatacaaattaaacgccctaaccgctatgacaccgactagctcagactttgaaatcaacggtcaggccatgcatcttaatatcggtggtcaatacaatatttataatgcgctagctgcctacgcggttgggcgcttcatggacgtcacgccggccaaaatcgcgcacgcccttagcgacaacgatgaacaagtctttggtcgtcaagagacctttcacgttggcgaaaaggacgtcacactgattctcgtcaagaatccagtgggccttaaccaagtcttgcaaacaatcagcaccgatgaccggccattctcatttgccgccctgctcaacgcaaactatgcagatggtattgatactagttggatctgggatggtaattttgaaaaattaccggcattgaatattcccgcctatattagtggcggtgaacgttatcgtgatatcacgttccggctaaaagttgctggcgtaccggaagatcagttaaccattattcctgacctgaccaacatgacgaccgcaattcaaaaactaccgaccaagcaagtctacgtcgtcgcaacttacaccgcgatgttacaattacgaaaacaacttgctagccaaggcattatcgatggggggatggcttaaccatgacttatacactacacgccgcacacctctacggcgatctaatgaacacgtatggtgatatcggtaacattttagcaatgcgttactatgctaaagcagtggaggccgacatcactgttgacttagttagcttggatgatcggtttgacggagaaaaatatgacttcgccctcttcggcggtggtcaagattacgagcaaacgattgtttccaaggatttacaaacgaaaaaagacgccttgaccgcatatatcgaagccggtggcccattattagcaatctgtggtggctttcaaatgctgggccattactacattggggcccatggtgaaaagatcgcgggtatcggtgccttagatcattacacgctcagtcaggataacaatcgctttattggtaatataaccattgagaacgccgaaacccaccagacctactatggttttgaaaaccacaacgggatgaccttcctgggcgaaggtgaacggccccttggtcaagtgctccaaggtaacggcaataatggcaaagatcaatctgagggcgttatctacaagaacacctttgggtcttacttccatggtccaatccttgcacgcaatgaagccctcgccaaacgaatcttgaaactggccttacaacgtaagtaccctgaaggcaacttcgatgcactggatcaactcaacgaagacctcactaaaaacgttatcgtgaaaccttaaaacgtatcactcaaaatcgccactgacttagttaccagccagtgacgatttttttagtttgatccgtattaattggttacaatgataacagtttttggaagccttctcattagtaaaccccttcaagctataataaatatttatatactttcagatagtgattattaataaactgatgctatcagtagatacacaaaaaaagattgatagtggcttccaaccagtatcaatcttttttatcccatcaaggggttaactaattacgccttagccccaggttctgaagcaataatttgtaaatcgcctttcaatgtccattgttttacgtcaaatggcaagataaagtggacgcccttactcaatggatagtcttgaccgtcaacgacaatgctaccttcaccatccagtacagagactaacgtataaggtgctgttccccggttaaaagttgcttgcccatttgttagccgccattgccaaacaccaaagaatggtgattggacgtatttggtcaccgttgcatccccaacctgggtagtcgtgatgtcaaggtcagggtcatgatgcggaacgttagttgtatcaatggattgttgcaaatgcagttcgcgcttctgaccagtggtcttgtcgacccggtcccaatcatatagccggtaagtcgtatcagaactctgctgcgtttctaacaccataattcccttaccaacggcgtgaatcgttccagatggaacataaaggaaatcaccaggcttaacgggcactcgccgtaatagcttatcccattcaccgttgttgatccattcagcgagctgttcacgggtcttcgcatgatgaccataaatcatcgttgcacccggttcagccgcaatcacgtaccagcattcagtcttgccaagttcgtgctcgtgttcagccgcgtacgcatcatcaggatgcacttgcaccgacaaatcttcactagcatccaagattttcgttaatagtgggaagacatctcccttagcatcaccgaacacatcacgatgttctgcccatacccgatccagtgtcatgccagcgtacggcccattttcaacggtcgccggaccatgcggatgagctgaaatagcccaacattcaccagtatgatcactgggaatatcataattaaaatcatcatgtaatttggtaccgccccaaattttttcatggaacaccggctttaaaaagtatggctcactcataagatctactcactccattgttgaatttaatatctaaattttagcataaatgaaagcggttgtgaaaccgaagtagctaatttgtaaccgtatctgccaaccaagccgcaattaaccggcgacgtgctggaaggaataccgaattatttgcaactggatgcacccggttggataagaaaacaaggccccgttgccgttgacggtcaagcatcaggagcgtaccagtataaccagtatgaaaaatcaccggcagtgtctcatcagaacggtgccagaggttccaaccaaagctccggcgtaagtgttgattgggcgtccaatcttgatacaagcttgcaatcgtagcctgtgatagcacagctggtacgtcgatttggccgagcatcaattgtgaaaaccgaacaaggtctgtcacactggcaaataaaccggcggaaccacagtgttcacctaagactctggccttaggatcatgaacgatcccccgtaacaacccagttttcatggaatacgtcgtcggaacggtttgcgctagttgaggttggaaactcgtgtgtactaaccctaatggctgcaaaacgcgctcagtgataattggctgaatggccgctccaagaattcgttcaatgacttgccccatgatgatcaagcctaaatccgtataaaccacccgatgattgcggttacgctcactgattggtagctgttgaatcgcggctaataacgcatctgcagacaacgcattccgatttggaatataaccactcagcccacttgtatgggtcatcaaattacgaaccgtaatcgttgtggactgtaaagccggtaggtagtcatgcacggggcggtcaatttcaagttgcccattttgcatcaactgcatcgccacggttgttgttcccacgaccttagtaaccgaggctaaatcatacatcgcatccggccataatggtttgatcgttggttttatttgagcgacgcccacttgattcgtgtgccactcagccccatcaatcaaggcataactcgcccctgggatcacttgatcttggaccatttggttaattagtgctgcggttctactgaaagttaacattaatttattcattctctcttattaggatcatgattcaagttgggattgactgtggctaaaccaccttcaaggtcagtatcaaccaagtaacctggcaaactgtccacgttttaccctgacaatttctgcggatacgaactgacctgactgcatcaacgacctgcccgaagctagtgctgacttccgaataaccgcggtaatgtgaccaaccaataactgattaaagcggccccgccaatgacgagaagccattgattcgagacaacctgatgattatacagtaacgtacagcccaccaaaattcccgtgctgacccattcaactgtctgccaatgtcgattactccactttatcatcttgcccaactccctttaattttagcgtttcttcagcaactttacatcacaatcagcaatcttaacctaaccgtaacgtccccttagccgaataactgtcgttccgatcatgcgtctactgattagacagcatttcttactattcacaataccacgtgcatcatgcgcacgcacataaaaacgactttagttccacccgtatcacgggtcttactaaagccgtctttttattcacacaaacaacactgtacttagtctaattcaactttctggacccaaccttcaggcgcttcccgatcgccaaattgaattccagttaattcatcatataattttttcgttaccggaccaacttccgtttcactgtagaacacgtgtaacttgccttgatgttccaagccaccgattggtgaaataaccgcagctgtcccacaagccccagcttcagcaaaccggtctaaatcatcaatgtagacgtcgccttgttcagtcttcatcccaaatttatgttctgccaagtagagtaatgaatatttcgtaacggaaggtagaattgatggtgacttgggtgtcacaaaagtgccatccttagtaatcccgaagaagttcgctgaacctacttcttcaatcttacgatgttcaaccgggtcaagataaacacagtcggagaaaccgttggcatgagcttcttgacctgggaataagctagccgcataattcccaccaactttataagccccggttcctttatgggccgcacgatcatattcggacgtcgtaaagttggttggcgtcatcccgcctttgaaataactaccaactggcatggcaaagaccgtgaagatgtattcctgagctggatgaacaccaatgttacccccaaccccgatcatcaatggccgtaagtataaagtcgcaccagttccatacggtggcacgtaatcttgattagccttaacaacctgtttaacagcgtccacaaacatgtctgtcggcacttgtggcattaataaccgttcacaactggtctgcattcgggctgcattacgatctggccggaataattgaacactaccatctttagtgcggtaagcttttaagccttcaaagtcttgttgaccatagtgtaatgctgttgagccttcactaatatgtaaagttgcatctcccgttaattcttttttgtaccaagcaccatctttccaatacgcacgataacggtacggaagattccgatattcaaaccccaagttgttccagtctaattgtacgtctgccatatgcttcgacttcctttatatgtaattttccaaattaattaatttgaatttaattaaaagattaatggttaattagaagtttgtcaagggcccgtcaaacatttccaacgctttaagatttttttggtataatgagtgtaaatttagcaaaggactggtttgtcgtggctagtaattcagattcaatttataacgtcatgttctatatcacccatcacccgactgaaattcagtttacccaaccggaatacacgaatgtcgttcggatgggtgtccccgatcatattaaggtcgctaaccccgaaatttattttcctgacaacaagctattagtcaaccgatttcaggatgactttgtcgctaaaaacggcaacttacttgatttcttcttcgattacacagagaaaaaagtccctaactaccatgaagtgtgggtttcttcggcccatttaccagccaaacacttatacttcttagagttatcatttgagtaatttaacgcacgtaacctttacggtctatttggaatcaaatttaaaatggatcaatcaaaaaatcaccacctggattatgttcatccaggtggtgattttttgattactttacaagcgtaaaatgcagccgacttagaactacgggttcgtcccgtcataacctcgaatagtgagctttacttgactaatcaaagtccagtcgcgctcataaaacattacttagtcataaagatatacaagtcagacgtggagacaccaatcgtgaagcgaacgcccttagaggtaatcggatcgattgtcgtcgtactaccactattatccttggtttccttctggaactgtttcataaccttcttggcattggcgcccgttgttgtcgtcatcaaagcaaacgccgtcccaaagttcttctggcgggtcttgttcttaaaggccttggttggaacaatcatcgctgcccctaatacgtcacccttctgaacatttagccggatcttataatccttagttgttaacacgttcttgatgccatcacttggcgtcttcgtcggtaacaattgcgacttgacctgctttttcgccgttgccattgccgcttcgacctgcttctgagtcgtttgcaaactagctgctttggtcttgagctgcaccgcagcagtttgttgggcttggagtgtcttagcacccgtggcagccgccgtaccgccagccttgatttgggcctgggcttgcttgactttggctcggatcgttgcttgttgctttttaagggctgcaccctcagtttgcaacttcttagccgcctgttgatcagacttgctgagtttagaagcaatcaaagcctgattgtaagtcgtcgccatcttttgatagccaactagcttcttggcgccctttacgtgcaccgtcgtggtatccgaaccggccttaatcttcaccgtttggcgggtcgtcttggtcggaacttgaataacaaacgtatgattacgcaccgtcgccgtcttcgtctgaccaccgtcaagctgataatgaacctttttaacgttggattttcctttgacggccgctactaacccgttcggcttgtatgtggttttagtcgttgataaggttgtcttaccacagcccgctaataagaacattagcgcacccgcagtaacggcaaccattgctgttttccggaacaattgacacccctcctttagtcgagactaatattgccagtaaattgactgttatatagatccgcatagaacccattttgagccatcaactgttcatgcgtcccagtttcaaccactgacccatggttcatcacaataatgttgtccgcaccctgaatcgttgataaccggtgcgcaaccacaaaactggtccggttcttcaggagtcgttccatggcatgctgaatatgcacttcagtccgcgtatcaaccgaactcgttgcttcatccaaaatcagaatttctggattagccacaaacgcccgggcaatcgtcaataattggcgttgtccctgtgaaatatttgaagcttcttcgttcagaaccgtctgataaccatctggcaatttgcgaacaaagctatcaacatgggccgctttagccgcagcataaatctcttcatctgacgcatcttcacggccgtacttcaagttgtcgaaaatcgtcccagtaaagagccaggtatcttgaagcaccatcgcaaagtgtgaccgcaagtcttcacgatccaggtcccgtgtatcggtccctttcaatttaatagaaccacctttgatgtcataaaaacgttccaacaaattaatgatggtcgtcttaccagcaccagttggcccaacgatggccacttgttgcccacgtttaacgtccagattataatccttcattaacaggtcgttatccgcataaccaaattgaacgtgttgcagactaatcaagttatcactatctggttcggctggtaagttggatttcgtctgtttcatttcttcttcatcaagcacttcaaagacccgttcagcggaagccacggtcgattgaatcgtgttcaacaagttcgccatttgtgaaatcggttgtgaaaattgttgcgtgtattgtaagaacgcttgaatgttacctaacgaaacgttcccgttagccacatcaatcccaccaatgatggcaacaaagacgtagccaatattatttaagaacatcatcagtggcatgataatacctgaaataaattgcgctttccaggctgattgataataattattgttttggatttcaaaatcatcgatggcatcttgttccttgttaaagctcttgatgaccacgtgtccagcatagttttcttcaacttggttattcaacaaccccaagctcttttgctgtgttccgaagaatttctgtgatttcggcgcaatcacaccaaccaccacgacactcagtggaatggtaacgagtgcaatcaaggtcagcttccaactaatcgtcagcatcatccataaggtcccaacaaaggtgacggtacttgtcaccgcttgggttaggttttgctgcaacgtgttggcaatattatccatatcattgacggcccgactcataatgtccccattcgaatgggtatcataatatgaaatcggcaccttttgcatcttacccttaaatgaacgccgcaacttatacacggtccgttgggaaatccgcgtcataatgtactgttgaataaagttgaacagtgctgaggctaagtacatgatcaaaacgatcataataatctgaccgattttttcaaagttgattgggtaaccggattgactgataccagccttctgttgcgcggcccccttcataattcccttataaagttcggtcgttgctttacctaaaatcttaggtgttcgaatctggaaaatcacggaagcaatggcaaaaatcatgaccactgccaaaccgacccaccggtctgacatgtagcgcatcaatcgaatcgccgttttccaaaaactcttaggcttttcaactagtccagcatgaccaccggggccatgaccgccagcaggacgtgcaggcttagtagaactcgtattcttttcgctcattacagctgatcctcctctcgtaattgtgacttcataatttcttgataaacttcattattagctttcaattcagcgtgggtccccttgccgactaacttaccgttatctaggaccaagatcagatcagcatccgccaccgtcgcaatccgttgcgccacgatgactacgacactctgttgaatctgtttatcctggcgtaattcagcccgtaattgagcatcagtcttgaagtccaatgcggagaaagaatcatcaaatacataagcggaagcctgtttgacaagtgcacgagcaattgctaatcgttgccgttgaccaccagagaagttacccccaccttgttcaacgtgtgcatccaggccgccttcttctttaacgaagtcagttgaacgagcaatttctaacgcatgccagatttcatcatcggtcgcgtgttcgttaccgaattgcatattttcacgaatcgtccccgtgaataaagtagcagtttgcggaacaaacgaaacggcttgatgtaaatcagctaacttcaactgccgaacatctttcccatctaatttgaccgccccactctcaatatcatagaatcgggggattaaattaacgagcgtggtcttcccagaaccggtcccaccaataatggcaacggtctgtccagaatgggctttaaagtcaatatctgccagcgctaattgctccgcactttgatatcgatagttgacatgatcaaattctaagctgtgttcagtcgtcactggtaacgttgctgccttgtcagggtcagtaattttaggttcaatactcaagacttcttgaatccgggaagcggaagcggccgcccgtgggatgaacgcaaataccatggcaagcatcatgaaactcatcaatacttgcatggcataagtcataaacgcaatcatattcccaacttgcattgtttggctactaatcaattggccaccaaaccagacaattgccacattagtcccactcataatcagagtcattaccgggtaagccaaggccacaatcgtattaaccttaatcgcattgtgcgtgtaatcttggttagcgtcttcaaaacggtcctgttcaaatttatcttgacggaatgcccgaataacgcgtactcccgttaagccttcacgaaaaacaaggttgatgcggtcagtcttagtttgcatcgcccgaaacaacggtattgcaaacgccatgatcaaaccaataaaaatcaatagtaccggaatagaaaccacgaagatccaagttaattcatgactcttggtatacgctaaaaagcttgcaccaatcagcatgattggtgccataatcatcattcgtaacgccatcatggccacgttttgaatctggacgacgtcattggtcgttcgagtgattagtgaagacgtctcaactttatcaaattcatcatttgaaaagttgatgaccttcttataaatatccgaccgtaaattcttccctaattgttgtgatgaccgcgccgccaaaaagacgttgccaaacgctgcgacgactgataacaatgaaaaaccaatcatttcaaatccgattttccagatataactaatgtcaccagtagccaccccgttattcacaatattagatgtcaaactaggcagatttaaggtcgcaatcacttgcacgatcataaataagaccgcaccgattaccgcggaatacgaaatccgaccctttgctattttaagcatttgcacgctccccttcattcattattacataataatgcagtatcttaatctaactaaaaacggtccttttgtcaaccatctttacaagtctcacgtaaaatattgtaacgcactcatcgcagtttagcactcaaaaggatttaagaatttattaagctcgccttcgtaataacacaaaaaaagtgctgcgtcactaatcgctgacacggcactatgcctaaatttaagccaatacttcttgtatattttgaggtacctgatttgtcgcaacggcctcccatgaattcacgttttgtcccttcgtctcaatctttaaatagtgtcgttgctttagccggtgatctgcggtaaatgtcaaccagcgttgcttaccttgcgcatcgctggtcagcattcgataggtatagatatcttcgcccatctgaccagtcgagtggccgattgcctgattagtccgaccatagaccgtttgtaccttaacaaatgggtttaagttatccaccgccattgccagctcactcccctgattcttcgtcatcgtcggtacaattaacaatgtacctacactaatcatcataataatcgccgccaaccaaatagccctttttttattcataaatactatcccccgaattaattattttattaatcgtatcggagtaaagctcctctggctaccctaactaggctttcttaatcagtttaaacgattactaatcaaattcgattttccttaaacattaaggaaattattttaacaataattcaataattatcgcgctttgcatgctattctattagaataggaagtagtttttaaatcatggggggatttatcatgcacatgcggggtatcaactttgtattaggtctcggcgtcgcgctcggcctgttaacaggctgtcaggcggcttcaccggcaactaaacaagccagcagtcaatcatctaagactagcgctaaaagcgttcacagctcggctaaacaccaagcacggccttatcaacattggcataccgtcaaagatgttcacttgcctattttgatgtatcacagtatttctagcgggaaccagttacgtgtccccgccaaagaatttcaaactgaaatgacttatctaaaggcacacggctaccgaacgctgactgccaatgaagccgtatacgcgctcaaacatcggcgaattccacaaaagaagattgtctggatcacactcgacgatagctataaagataacatgacagcagcttggccaattttgaaacagacgcaccaacacgccaccattaattttattaccggctttacctataagaagaaccacttaaccttagctgatgctaagcggatgcaagcatccggtaatattgattttcaaagtcacaccgttcgccatctggatttaaacaatttaacttaccaggttcaacttacggaattatcaagttccaaaaaatggctcgatcataatttacaacagaacacacaagttatttgttacccagccggccgtgctaatcagcagaccattaaagctgacaaacaggctggctatcagtatgccttatcaacggcacctggcattgccaccagcacacagaacccgtacaatctcactcgacaacgggtcgtacctggaatgtcgctaacggcctttcagacactattaacgagtaataattaattcataggacccttacttgtgacacgatcccaaaacccttttttatgagcgcttaacagtgctgttgtgatcacaacagccaaaacgcaaaattggggttttaatttgataccaattagcaaaagagaagcgtcataatgctgatataccagcattatgacgcttctctttttatctaccgacgtcgacttatcacccgcacggtagttataccattaagggtagcacgctataaatgccatttataagccatttctgaaaaagagagatttttaatttacaaatcgtggaagagcacaaattaatttaatattggcccttttttgatgttttgctttttccactattatataccaacttattatcttaaacataaaaaagtcccacaccagccaattaaggttagtgtgggatttgttgtcattttttccaaagttgttaatcacagcaatgcaattaaagtgtggctagtatcgactttacctagtcagatttaacttggatcttttctctccactgtatttctggaaatcccattaaatctaacacttttcctatcccaattgactttaacttataattgcttttttctataagactattgatactatacgtcattgctttaaactgcttacgtgtcaaaaccaaagcaagtaacgatatgagtgcaaataaatctactggcttttctaagtcatcgaacattgggttattcatatagtacttgctgaacaacgacttcggaatctttgtccttaagctgtaattgtaaaaacgttcatcatgtgcacaaacatttctaaacagatttgcaacaataattaaggatttcaattctcctgtatcaatcttttcactggatttccaatgcaatttataatattcactgaagtctctcgcaactttctcctttaggttttgatccaatgagtcataaagatattgtatttcaccaaaagtcaacgtattaactagcacccacaacggtacatgggtatgttgctgaacataatgaataatactaggcttaccatacctttcatttcttcccctgttgagttttagtgaaaggttttttaagttttttagaacgttggacagatcaccaatatcgttggaataattcacaatatttaaataactgtacgggtctggaaatttttgtgcaaactcataacttataatcgactttaagcgggattcaaatatcaacaaataatttaatactatatttctcaaatctctgtcaaatccatatagtgtatacacatctgaaaaagtagttttatggataaacatctcaggcttaagagcctcacctgcaccatcttttcttaaaaatggatctttatagccattaattacactgtaataattattattaagtaaaacctgtcttgcataatctgtgttatcaattttcataccacgattcttcaacatctttaattgagcatctaaactggtaaaaggtttatctgtactgtatgtcatatggtctactcctaaaaaaaaatccaccccgcggacggaatggacaaggtcttatgtgtgtaatgatatagattgacgacatttttgtcaagaatttgattatcacttaaatgtagaaagacgaatattttcctatatttagtaattgaatgatcaaatggtttgcaaaatcgccatatgttgtgtttatttttttatgtattaaagttgcacgatttctcatgtattcctatgataatacggaacctagtaataatctggtttcctctttcgctgagatactttctcttatgtattagccatctacctttacagcaggcggctttttacgcaaaaaattccccacgccgaagcgcaggggaattaatcaagttataactatcatctagaaactacactagagacaattagtattatacttattacttgctattctgtaaagtattgtagttatctaattagctatattgacagctaataatgctaaatctaaactctcactaacaaaatatacaggcaagcaacacaaaaaaatcttccactcatcaagcagaagattatcctcatcacttccggcaccactaaccgacaatcttggggggatttgaaagctgtgatactaataacaggacaagggacataataacacttgtcggtttatatcacaataccgaaagtaatctatagaaaaatattaataagtccttgttatattaatcaggtttaatgtataataactgtgttctttattatcttaggagaaacagaacacccattttatttatttaaacattgggccagtcttgactggctcttttttatatattttgttaacaaaaaatcccccacgccgaagcatgggggactagaacagttcacgattattatactactttttctcctgattgtgaggcggattctgacgtcgtttcagtgtcagatgatgcagaactattcactgcagcgactgcggactctggcccttgcacttcatcagcaaccttattagcggtcgcttcaacttggctttcctcgtcacttttaactgttggtgctgtcactgtttgaacgtcagtaacaacgcccagcataccaaggatggttaacacggtgttaacaacggcaacaatggctgaccaatcaccagtaaacttaatgccaaacatggcaaagacttgttgaaccaaaacgatcagtaaggaaatgatcccagcgatcaatttaccattcaagctaccgtcagcattcttgaagctaatttttttaatcatattttccctcctaaaggaacttttctgcgatgtaaataactaacgtgacgagcacgccactaaccaagataccaattagcccattttgaatggttgtcacgcggtcaatttgatggctagcttcaatggacttggccagtgccttgtcagctttgtctccaatatcgtcaacttgattcagcttttcttcgatgttctcaactttcgttttggtggcggccacatccttttgaatatccattaatagcttagttgcatcatcatattgtgtcattaccgcaccaccaatcgctggccgggatagatagtggtgtaaattgacttgccattctggctagctagtgtagtcatgctcaggccgttgcgttgtgcgatcgcccaccagctgtcgccagacttgactgtgtaatacgtatgactaaccggctgaccagtaactcgcttcccgtaggctggcccattggtgacgcctagcttaatgaatccgtataggccatttgaacgggtgtaacgtgcccagacatagtcgtgttcgataataaccgcgttataaattacactctcacccttgtaataggtagctacttggctaactttgtcgctatccgtgtatcgtacggccagagtacgattagggtagaacaccccacgttgactatatttaacgaccttagctgcctgtgcctgcttaacgttggcttgagcttgcttcttactagcagttgtatagcctgatttagtgatccccgttaaatcaacgttgccatctaatccgcctgctttgtaagtgctggtgaattggaagatagccacgccgtccatacttgggaaccagttataatccggcttagttctaaccagatagtccggatattcagctagccatagacagctaccgtaggcacgtacaatggcgctagtattaacatatgcattgagataggccttgccggagtacagcataggagtatagccagcgtctttaatgagggccatttgagctagaatgacattagtgttagctgtcacgctattagaagcaccgtcctcatagtctagtgcgacaatactacccttgggagtcctaacacgtggcaagtagtaggccatcatagccttggcattggtcatattgccaccgacaccatcccacaaatacgtgtgtacccgtttaccagcctgttgagcactggcaacttggctgttatacgtggtttgagggatattagtgccaccatagaagccacccgcctgtgagaatacaaacttatcggtgctatagccgaacacaccactattaccgttatacttagaccaatcaaccccttggtcccggctagttgaagcctgactagtaacattgaccattaaaaaggccataaaaatagcccccaccgttaagatgagtgccttcaacttgcacttattcaattgtctaccccctattgtacgctgttattatctacggtagctgatgactgtgcttctgatgttgctggtgttaccggtgttcctgatgttgttgacgttgttggtgctacatatgcttcaccggtaataaccttgtaatcgtcagcagtaatgccatccggtaatccaacgactgttgctagtgtttccttggtaattgttttccaatcttgatatgcccacgtataaatttgaaccatattatgctgtcccctttgctgattgactaagtgcgagttctgtgatcgacttctgtaactgactgatacttgttgcggataccgtctgttgctgtgctaaagccgttgccgactgtacagcttgctgacttgtttctaacacgctggaatacttagtattcaactcttcaagcgaaacatttggcaagttgcccggattgagtaaaacatttttatccgtatcgtaccgaaatttgtcggaatgctgggcaaactgggtaatccatgaatcaagaatgaacaccctagtaaacccgtctgcctcggtgttctggtaagctgtaatgaaaccatctgtgtcataagtgatgtaaataaacatataatcgtcctttctaaactgttgttcctgtagcatctacccagttttttcctgtgtaccatattggcttgtttaagctagtgtcaaaatactggtagcctgtgctaatgccagttggtctagcagctgtattacctgttgacaaatgtaaaactgctgaatcatcagcaggtgtgtaaccaattttatcttgtttggcgttaacctcctcaatccctgcgacgtcactagctggtttacgcatatctgaaacattaactttatcttccggagctggagtccaatcaatagcttgtgttccccagtacaaacataatgagtttcctaagactgtaaaattatgaggtgttgtatttgattttgtctgcataaggtttatgccaagtctgttactatctacagcgtctgaacttttgccaaactgtaaagcatatgttcctttccaaacattattacccatttcaagccacttaaaaccgagaacgctaaagtagtcagttccaacaacattatcattaccccaggtgactccatctagctttattctgtcaaaaatattggtttttgtcgggtcatcctgagtacttatttcaaaagaaattgtgataggatgagtagttccttggttagtaatcttaaaaaactcgggagtaactgttccgattgtcgtattagaccatcctgcagcacctactggtgtgactaagacatcacctaggcttcttaccaggtttcgtccaccaatagtatctgataacttattgaatggctgtacctgaactccattaagctgttcagttccattcttgttatcagtaacttttgtgctcaatccattgtttaaatcagtaacagtagtgtagttacttaaatctggagtgtcacctttgtcacccttgtcacccttagcgattgtgcttgcagccttattcattgcttcaacaaagtcatcaaaagtaatggttgtaatcgtggcgccattggcactttgaatgttattggtaatagtgaacccagttgacccatcactagggtaaattgacgttccaatactatcagccacccatacttcaatggcgtagctaccagctggtagactatttatcaactcagcgctaaatttaacggtaattttaccagtccatgaatcagctaacttatttggatcaattttgatcgatttaagatagccactatcatttcccaatttaacggtaattgaagtggcatgagttaaatccactgccgtattatcattgccacaaactaacgtaaagctagtggtggtatcaccaattttgaccgtctgtgatgaagtatcagtaaaactaagtgttttttccgttttaggttcctcctttttagccaacttggcattaattacgcagcaacggtactaactaattgattatactgatcagcagtaatcattgctgctgacttaaatgttgctaaatcatctttagtgtataatccaatttcaaagtagtatttgataaattcaaacataattcgtacctcctatttggtttcagctattggtgttgatgttgatactggtgttttttttgtgtctgccaattgtaacagcatttttgcattaaactcatcttgctttttctgcatcgttgccatttgcaatgctaattttgcttggaaccgttgttcatcgcttggctgatatttaacgacatctggaattgttgcaacatagttagggtctttggttaaaacattatctatcaattggaatgcttgcggttgcgtgcttgccaagaaatcatctggaatttcaccctcataagttgtcgcccctgttagtccaccgacggtagcatagcttgtcacgtgtccggtcgcatccagcactaattgtaagctaatttgattatccattattttaatccctcgactttcgttaagacgacgtcactaagagggtcggctttgctactaccattgttaatcaatgcctttgatagtttcatcgccttttgatcatccattcgatctagagttagctctgcagcccggatggctccaccatcaccgctaagcccaacctgtgtcaaccaaaatgtggatttattagttgatcgttcgacataatcatttcctagcggggtcgtcaacttaaaacgcaaacgatcaaaattattgacatcagcagctaatttcaaggtatcaccaactttagcacctccactccataaatccatcgcagtattagtttcagctttgcgccacttgccttggaacttttccatcgtggtcaagccgccaatgaatagcaaaataccgttgtctgcatctccaaaactggctaaaaggtagccattgagatagctaatatccattaaaggtcgattagccgtctttgagtagtaatagtacaggccactttggttaatctggtgaatatcattatttggaattgattttactttcatagaatcaatggctgatagcggtactcccttaatattaataccgtccacaaagtttttaatgccagcaatattgttttgtgtactggtggtgttcactaatttgtcagcatccgcaatagcagccatttcggttattggatgaatcacggttccattaacatcttgtaactctttaatagacatctttactagccctccttaataaaaaccgcattatttatcttgctgttaaattcagcctttgacacgacatccttatctgccagctgaatcttgatgctatttaaccggtcactaatattttgtatttcggttatgaaggttcgttgttcgccttttaaatccgagattaattgttcatactcgctcaaataactttcagaattaattccaaattcaactaaattaggtgatacgtctactaccacatcaattgtcgtgtctacattatcgccaagtaatattttaaagaaagcttgtcggaatggtccccgtgctgtgaaagtttgaggtgggaaagtatatctaaagatgccatcttgcggatctaacacaatgccaccactggtatcaataatcttggtaccatctgatttgaccccttcaaaattgacatgtttaccagttaaatcatagggggaattattggagttcaattgtactgtaacggttttcaagccaccatcgcccacacgggcataaatggcttgttgcgtcgtttgtaaatttggctgttttgtaatgtcgtatactaactcttgattagccattgttatctccttttttaattatcgtaataatacgaataatctttagcaatttcctgcacgatatactgatgagcttccggagttggatgtacgccatcgtgcatcattgttttcttaaaggccggattatccggctcaaaaatactcgtgggtttcattaggtcaacataaggaatatcttgttgattaagatatttcttttgggcttccatatagtcaatcagcgttaagccgaaggcatttttagaatgttctgtccggtaactactgttcacatcgacgcactgacgggtacaattgaccacaattaacttagcattcgggttattatttttaacccgtttaattgtttcctgcaaaccgcccagatatgttttaatgtccgtgtcaccaatatatcctaacttaatatcatgcacccaatcatcatcggtaccctgaatgatcaccacattacatttttgtagacggctggcttgattgacaattgcgttattatcataatcactcattttagcaccactaacactaaggttttcaacatagatgtcatattgatgagttaaaatatccggaaatcccccagcacgtgacgatacgctgtctccgatgacaccgattttgttggctttagtcagtgatgattgctttacaaagtcatacaaaacttgtccacgtgcagtctcatataggttaggcaactgattaatagcctcaccatttggttcttgaattgtcggtgcagctacattagttgtatcgcctaaaacaatggcacgaatttcacgcgtgtacttttcatctaatttgttgaactgatttttcgtgtcttggctgaactctttagcggtattttgtacttcagcaatcgcttcagcagtttgtgccatggcttcgcggacatcaattccatactgcttttcgcgaatcgcatttggaagttcctccaaatctagttttcccgtaatgcgagaacgatcacgataatatttatcttggttgctcaaaattttacctcctagttaaatactggttcttgaaccgttctgatggttcttggttcatatccaccttggtattaataccatccaaagtgcctttgtcggtatattgccataagtcataaggatatagcggcttagtaccataacttggaatccaaatactcccaaccttagtggtatcaagattgagttgttgatacaaatggttcgcaatatatagcacaatttggctatttggaacgccccagtcattaagctggctaatgtacgcgttaacggtgccacgcatatcgttattctcgatggtttcaacatcaagggcatagaaccgcggttgttgttgcccttgggtcacgctttgaacacgtcgataaaaagcacgtgcttcggctcgactatcagattcatcaacccctctaaagaacgcatatacggcgtaattgagtttattggctaagacaccctgaatatttttaacatatttggcatcgatatgattactaccgtcttggattctaataatccctaaggctaaaccagcgttgccgacttgcgaccaattaatatcactttggaactctgatacgtcaacaatcgcaccgttgtaatagcttggttgatcgtgtggtggatttggattagatccactcggattagctggatgagattcatttggagaaatttgtacgttattttgcatattaaatgacgtaatatactcactaaagctcttaagctgattgattaccctggcttgattaatttgttgactggtcaggtttttattctgatttccaatcttaatcgtgacggtttgcgggttaactagatcaacttctttttcgctaacactaatcgtttcatcaatatccataaacttatcaataatacgatagctattaccgaccgtaaacgattgaaaccgtttgtcaattaaagctagattaacaatgtcaacactccaagcaatctcggctgatacttgtttttcaagatattgttcaccctttgttttgaggatcccagcatcgtgcacatcgtcccaaacattaacattttcgataatgccaaatttatcaattagttttggatcatctaaataacgtctaccattattaacgctagaaatatcaatcttaggaatcggcttattgctatctcgcttatcgtctttttgtgctttttcagcgcctaagggaatcaaacgagtaataagattgttgacgttaagattgcgcgtaaagctctttaaattcacgcctaactcgatcgtttgcttggtgtccgttcccagacgattgacatagtccaaaatcaactgaccatgagaattgcgtccaatacgtaaaaagcctcctagtcgattgactaaattgtccgtaatgttgtctaacgtgtctttagtttcgtctaaataacggtaaacattatcagtgctattagttacattgacagttcccaaggttatttttttgaaatcatcgacttgtctattatgttcatcgactatgatttttaaaaagtcattgacactggtgttatgaatctcacggtaaacttgggcgctgtcatgtagataagctagttcgctttcaaaactcaatgtttgtgtatgcgtggttgaatacactttactaactttgatgaagcggcctcggaaaatagttttttttgtctggaggtcttcaattctgataaaccagcgataaggcaaaatccgattgaacaacgtattttctaggctaatggttaacgttccagtgtctattccaccagacactaagcttagatttcccgatacaatccgattgccatacacatccggttcgttaatagattcttcatttccaagataggtttcacgaactaatattttgtacactacaacatcacttcgctttcccattgaaactcaacatcaccgttaccactaactgtaaaattattgattccgggttttaatctaaagttagggtcatcttgataatttttggtgtatttatatttaccattaatcttcatatcattttgacagataaccttgagccttgatttcaaatcgctgtcattatacaagctaattcttttggtgccattgactgaatacttggtaaattgtgcataccctgcttccagattaaaattgtcccaaatatcgtcaaactgtcctttgcgtaacgcatagggcgagacgttgaattgcaccgttatttctaatacattgttaacatgatcatcatttgctgtgacactactagccttaccaaaccaataaaacgggaggtcatgactatcgtaaatcggctgacgcattggtattagcagcagtcttttacactttcgttctagtaacttacgatcgtgataattaatatttagtgctttaaattgatattcaatcgtacggttatcgaagatacgccgtccaagtatatctgaaaaatcaattgtcccatccatataacctatactctcggtaacttctttagttggtgggttattggcagtccgaccagctaagtataaatttaattggcgactatcaaaattagcgaattgtacatattcttcaggttgtggttgttgatacccaaaataaatatcattatccattaccattaccaccgatacctccgttcatcttccatgcgttcgcctaattgctcgttagttacatcgatcaacttgccgttggcatttagatatactgggcgattttgttccaatgcaactaaaatacgactaagcatacttgttaacgagtcagcttcagtattctgttgatcatcagttacaacttttaacaattctcgtaacaatgaattagtttcactgttgtctcggtgatcaacattagtattaacatcggcaattggctgagcacgcatagttgtttccatcgccttagctaatagtggataagccgtgacgtcataaggattaattacaaactcatggtgttggctgttgtcgccaatgattgcagtttgctcgtcaaaaacttcgccaccgttagcaaaccgacgactaccttgtgggccgctatgcagccaatcaacctttggaacaccccaaatagaagtatgaccaatactgtttcgccaatcggagttattgaagaaagccaacaattcgtctagcggattcattcgattggtatgtcccggcattgcaaaagcagcaaatgttcctggcgtatattgcaaaataccaccggcttcattacccccactattcatatcatgaacagtttgaataacagatttaccgccagattcactcatgatagttgcttgcaaaagatcactgaaacctgatggaagactatcaatgtgcatcatcttggcagctttctcaattaagcctggattgtagtgaccagccttgccgtcagatacttccagtgtttttttggtgctattcagcatttccttgaacttattaactgctatgctcgacagcttgctaattgtgccactagctaattcgccaaaactagcttcccctttaaataggccatcagtagctttatgaagtagtttggaaatatttccaagcggatctttgaggaacttcccaacagccttggctttgtcgccaatccatgagccaatatcagataacttacctttagtccaattgattgcattgccaacaataccaccgtttgcataatgatcgacaccggcagacgccatgatagcagctgtttcatcgccattgtatactcgtgtaccagctggcaaaggtagcactgcattacgttggtgagtcatctttagttcaccagaaggtagttgtagcaattccttccagttctgaccggcaccatcgttaaccattgatagacgagtatgcacgacaccaccttgagcaaatttaactggctctaaatggtgaatactagttttatgaccagtaaagaatttccaaactgaatcgattgcatcaacgccagcgttaataacgctcaaaacgccgttaataccatcttgtgcggcctgcttgatacctttccagacattactgaagaagtctcctaatccttgccacataccatgccaaacggtgctgatcgcatctaatactgatgaaattatatcgtgcattccgtgcatgtaagctttaatcgcttgcgacaaggctttccaaatatctgaaaagacgtttttaatatctttccaaactttgctccagttaccatgaataatatcaagaacagtttgaattacatcagaaatgacgtgcattgctccaataatcagtggcttaatcacattccaaacggatttgactaccgcactaataattttccaagcagctttccaaatggctttgataatagccattcctgctgatataatccctttaattacagccataccaatatcaataattggcttaataatcgcccaagttgcttttacttcaagcgatatataaccccaagcaaccttccagactgcctttaccacagccatgccaagtttaagaacttgcttgaccatcttaattccagccgaaaccactggcttaatctctttccagaatgcctgaatggatttaattgctgacttaaagaacgggccaaacgtctttttgatccactttacagcatcaccaagccacctaacaacattcttataccaacctttgattgtgttaataagcccatttacgaacgcacggaactttttattgtgcttatataactcaactaaagcaaatatgattgccgcaatagctgcgatccaaattgtgaacggtactgcttttaatgctgctccaaatgattttagaacaccagaaccgccctttaatgaagacataaacgcggttactggcttaccaagatttttaaggccactagttatttttaagttatcgttaacagacctgatgccaccaacgaatttgctaacatttttcaaaacaaaaactccggctagtattttaccgaaagtttgaatagctggtccattgcttgctaatgattttagaataccagctagtccgcctatagaccttgaagcatctttactgttatttgatgctttaccaagtggattaactaaaaatccgagcactgaaaccacgccattaatagctgcgcccacaactttaaaagcaatagttagactgctcttaacaatgctgccaaatgctttaatattatcagcatttttggcaagccaagctgaaagcttgtcgactgacttaccagcgtttttaaccatctgatctagggaacttgtaaagcccttgctagtgaaattgccgccagcaaaagctttagtaaccgtagcgaaccctttgcttaccttgttacctaaatttttaaataaactctcggtatgagtttcagaaacccatttagaaatggtaccaaagattgggttttgcgcttttagaagcggtttttcaatgtcacctagaagcttaggcatttgtgctttaaccgtccgttgcataccagtcatggtctttagcatattttcagccgctttaccatacttgtgattacctaattcagtaaaaacgctctcaaggtctttaccagtgatttttccttgactagccatatgacgcattcctgcaacggttgtatgttcatgcttggctagtgcttcatcaatcattgggaaataagcgcctatttgatttaattcgccagcagacactttaccagtagctagtccatgaaccatgtcctgagttactgacttcatttgatcgccagttaatccgacggcatcacccatattcaacatggcttttgacaactcatctgcttcaggcttactggagtgtaaatggtagaacccttgttctagctcgttaactaggctgctagcttgaccagtctgcttgcttaaatcattgattgtgctgaccataccttttgcttgataagctgacccagttaaggttgtccatgtttgcagcataacctgctgttctttgtcaaaatcatagccggctttaattgcttcaacaatgccatctttaactttgtcataagcgctgtacagtgcattaccaacaaatgtaccttggataatgtcacgtaagcggtggccgttctcacgtgttttcttggcgctatcgttaaactttttaaacccattactgaagccatcttttattcttagcagcaatgaatgtttcttaggagtttgcttaattcgttcactaaaatgtttgaacgtatcggtgaacttatccttcacacgcaaaaacacggagcgctccttaggaacgtcccgtactttgcgtgagaagatgccaatgttttcatcgttgattttagactttaatgtcgtcacaacatcatgtggaatttctttgagatggttaattaggctgctgatcttttcacggattgaattgcttgaattagctacttggtctttatactcattaaagttagctttggcttcgtccatcgcttctttctgtttggaagcataattgtgccacttttcaccactctcactaactttagatcccatgtcagcagcagcatgaactgcttcgtccatcgcttgacgtgcattagcaaccccttggctaatctgatccataaatttccacacaaatgtcttttcaacaactgcactcattaatcggcctcctctctgccagcttttgcctccatcagtcttcgatacatagccatttgaggcgtatcaggttgtcgttcttcggtagttcgataatcagttaatttgctaatttcgtttgcaatttgttcatcggaccgttctacaacttcgcctaacggttgactgagttcgacaccataagttgcctgtggcattaaacgagcgtgcatttgctcgcgctgctgattaagcatgttaacctgatagccatgccaaacagctttaaactcagccggcgttaactgctctaattgttccggagttaagcctgcgcttcggccgtaacttattgcggtgtaccaggttgcagaacttttttcagcttgtccagttgtgtttgaagttgttccatgcccaactgatcctgattgtattggtcgctgccctctttttccgattccagcttcttctgcataatatccatgatcttgttgtatcctttgacaaagctggtaagcttccgcgctaaaaaattatcagcgtgtaaagactgaatgatatcagaataagcgacgttagtcttgtcatcgtcagcaaagatagtgtcttctagcgcttctactactttgtcacgactaggttgtgaacgcttgaagtaagctaatgcgtaatagtatgcattcacaatttgatccgggtcttcgtctaacaagccatcaacaagtacgtcaaagccgtcacggccgttttcactgagttctttctttacttggttagcaaaagcatagttaagtttaggtgtacaagtagtaccatcaatcattaaattttccataatttaaatttcctccattaatgtccaagtgagctagtggtgccggtgccgccaatatcagtgttgtgggcaaaatcaaacatctttaacccgtcagctaatagttgcgggtcaagttcagccacctctaatacaccatcttgcgtattaccgtcgatattgtaagtgatattagcatgtaacaagttgttaactgcttcggtttctggcaatccattaggtttagccataccaaattcagcaggcacagacttaacttttccgccaacatctaaagttgcttcattgaaatccatgcgccaaatgccaatcgccacatctttttgaattgcttttttaagtccatcatgaatcttgtcaccgactgtccaatatgaatcgacgacaaatgtttctgatcgtgaaccagacgtatgcaaaacgccctgctttaggttgactgccgaactagcacgtgtattagttgcactagatgcagcttgtaatcccaacatttgaatcaaaactgatttatcatcccacgggaatttgaccccgtataaaattttgtcagcactctttgtttgtagctttaatccagccatatagtgtttcctcactttccatagacaaaaatatcaaataaataagccaaccgagttaacggccggccttctaaactgttatcaattaatttatgcattgacgagctgtcatacttagatggccattcagttagttccaatcgttgcatggcattagcaactttacggcctaatgcgtatgcttgaccaacattagctacatcagcatagacatcaacagcaacggtagctaagaaataatccaaaactttaatatcagtttgctcttgctcattctgcaagctgacaactacctgtggaaacttagttggtcgttgctggccgaaatcatataccggaacgttaaatgctcgcagacattttttaacgttcaatagtaagtcttcctccggtgacatatcaatcactccccaatactgccaaacgcatgatgtgttcaaattcattattaagcctcattgcgactttctcgccggtaggcttcataaacggttctggtgccattctataagtgccgaattctgtattgtggtcagtaccgaattccacgtaaacaccataataagtgacaccatcttgactggtgattggctttttattgtcgctcccagcaatagctgccaatgctcgcttctgatctgcaactgttgccattggcataatagatactgacttaccatcatcactaatcttgatttctagcgatccctgcaaagtccccgttggctcgtaaccagacttaccatgtccaacttgagtgcgttctaagccttgtgcagcctcttgctcacgtgcaccagcattcttgataaatgctttgctaagcgcaacggctcgtcgatattccttattggcttcttccatggcctctggcataccattgcgtgcaagccctctagcagtctcaaataattggttaaaataatcaacatcaattgagaatgtaacgacaggtattttgtcatagttattcgccatgtagtatcacctcattatgaatgatatagaacgccgtttgcttatcatgctgactaactttttgaatctcatgcaccgtatcgttatcaccttcaacatattcaccatcaaggccaatcgcatcggcctgataacgtccataaacacgaataatcgttgcgttgtacaccgtgccattcggggcaaatgttaaattgacctgttgaatattagcttgcactacttggcttcgatagctcgcttgatgattaaggccatcggggtctttatcaagaaacttagtcaataaataaaccttatctggataacgcatgccatcaccagccaatcgcagtagcaccgcgcgttgttttagcttgaccatcaacccaggcttgaagatctggatagtatggtgtcaggtcattaacgttgaactggaaagacagcccttcttcactgtgagacttttcgccttcgttatgaaatttattgaacttagtaacggccaaattctctacaatgtagtctaatcctgatggcaagcctgaaattctaaccgaacgtcccagatataaaacaatggcttgctctgcatgatcaatatatagcgttagtcgttttttttcactatcgttaggagtaatacctagtagagtaatgacgttttctaatgtcttactactgtcctgtgtgtcactcatagaatgcctcctgactagtggccgaggcttgtgataggatcagcgctagttacaaactgtgccatcggaatcaatttgtgatcgtagacttttgtccagttagtgccatcagctaagtcgtccatcgtaggataagctttacccgaatgctttgaagtgaagttactttcgttccaagataacccttgtggtgcaaagacaaaccggcggcggttaacaagatagtcaacaccatggttctttaacggatcacgattagtttcaattgcattagtaaccggcaattcagaataaccaactgcaccgcgagcgaacaaataactcgtgtacttggcaccacttactggtaagctatcgtcaaccacaatttgaacgcctttaatcttatcgccagcatcaggagcttggattgacgttggtacgttgccattcccatttaagacgaaggttgagccattcttagcatcaactaagttggcatcttgtaattgacggagaacatcagaatgaactgccacaatggccaagtctttatagcgatcacctagtaagaagcgggccttgttgaagttcttcaagctgaacgtggtatcagtcttatcagcagtagcgtctaattgattgacacccttcatgctgactgaactaaatactccagtgagagtttttagcagaagcttttcatagacgtgtgaccaataatcgctgacttgatcgccaatagcgcttaaaggatccgcacctgatagttcagccgataagtcagttgcactccaagcttggtcaaagcctaatttacgagcttgcgctaaatcagtagtaatcttgttgactaacaagtccgttgtgtcatcgggaacttgaggatcactgtcagctaatggcttgaacaatggcatgttggctactttgccagcgcctaataatgctgcaatttgtggtacgttttgaacgacaccactcgtgaaaaaagcgttgttttgtgttgatttttcagctaaatagttcccccatttttcagggattttcatatcacttaattgggtaatgtttgccataatttatctctccttgttattttccaacataaaacgactggctaatgggttgggcactagcaattaatttttgagcctgttctttgtcggtattgtaaatttcagtttgttttgttaaattccaaccatctttagaccatggattatcagtccctgcttcttgtgatgaagtattgttgctcccagtagtgacggattgcttaccagtcaataacttttcagtagccgcttgtacttggctatcaacgtatttctgcaataatcctagattatcgcttgtggaatcttcgtcagcacccataaccagtggcaacatgtccgggctaatccccttgtcgagtaacattgacttggtcttgtattcctgaatctgagttgctaattcttgattttgtttagcaatttcagcttcacgttgtttacgatcagcttcagccttttgttcagcggtcattttagctcgttcttcggcctgcttttgcgcatcaaccagctgctgtttaaagtcagcttgctgttgatcaagtttcttagaccatttagcgtgctgttgaccaatcaattcatcaattttagcttgttgttcatcggtaaatgttacctgttcttcagactgcttaccaccttcagtgttggtttcctgattctttgattcttcactcattagataacctccatttaacgtctgtcgacttaattcgtttaacgcccgtcggctaaaagtgcataaaaaatagaccttttaatgccatatctagggcaataaaaaattagtcaagttcacttaagacatctttataatccatttgtactggaattacattgcaatggcagcgtgggtgaaacgggggtacgttcatgccgaccacagcgtctttaatttcaacgattgtaccatcgtggccctcacaatatctgcaaacatgaggattatctctggtaacaacctttagcttggtaaagcctaaattgctgtattgcttggcacattcccgcgtctgagttgctttactctcagtcactaaaatacgctccatatcagctttggttgacatgtagcgcttttgcattgttgtttcccataaattctcatttggattaggcttgccagcaacgcctaattcttttgcaacaattttactaatagaattagggttgacatgattttgcatttggaacttgataatgttatctaaatcaattgctaaattattggcatgtttgaagattaaattcaatgaggtattctcaggctcattttgagcagccactcgatacaatgcacgatgtctaagctgtttattgtacccacctaacccactaccagttagcttagttacctgttgaacgatctctgcctgcttagcttgaactaacttgttaacctttagtcccatgttagcgacgttaacgcgtgcttgagcctgggctacatctagattagttttgtaaggcagattatttaataacgtggctaatacttgttcttcctcacgagtagcactctgttttaactcaagcactgcatcggttagctctttaatgtctgcatcatcggcatcatcttgccaggttacatttttgtgtagaaagtaggctaaattcttaacctgggcatgatgtgaacgttcgataatgctaatcagctgttggaatactggatccttaacatctaaaatctttgctaaagcatgagccaatttattaatgtccataatcagccttctttgttgttattatcgggtaacgatgctttttcaccggttgcaaatatgttgcccagtccaccgtcaccttgagcgtaattatcgtcatcttccttagcagtttgggtatcctctttaacgcgttccgcttcggcatcagcattgattcctgtaattggttcagccatgtcacgaatggtttcgtcactgaatttaccagtaccatttagtaactggataagttgtgcggtcgcatcatcattcttaggcaagtttggcatgaagttagctttaatcatcttgttccatttgtcagaactaatttggttgagtgtttgccaatagctaacacaagcattcaagcgatcatgtaaaccacgtttaaacaacgtttcctgtagtttgcgttcttgatcactgccccacagtttataagacatagccacgccagaagcattggaagcaaagtttggatcgttgacattaggcgtattagtgtacttgtgaatttcgttgattaggaaattagtgtatgttgaccagccagcagcgtcatactgcttagttagatacttagcgtcgggttgaataatatgcttggcggttgaaccaacaccgccacttgctgcgaacggttctaaataccacatgtgatttttagggtcaacgtttggatgagctggttcaatgataatcggctgaccgtcttggcctatttttttattaccattctcgtccagcaaatacttaggttctgtcatattagaaaacttaccagttaagacgatattggcgttgttgaagtcttcctggaagtcagccatcatcgatacacttttgtccagtgcatctagttggtctagttcaggctcccaatcgcctaaccgctcatcattattgcgatactcggttaatggaacagtatcgaaaaagtgtggcaatgtatcatccaatactgcattggcaacgggtgaattagtttgaggcaaaccaccctgactatgaaaggtaaaaagctgactatcagtgtaaacctcataatgttccaccaattgattatctaagataccagtctgataataacgaacaccaacaagtggcttgtgatcgacagtatcatcatagatcacaaatgcttgtgttggatcaactcgaactagtcctaaatcagtcactccatttttaacgtatactaaatcatatgctcgaccagtgattgataagtccttcgctagttgctggttgacatagtctgcgttcgtattaacgataaaagtatctaatacattttggaacttttgtgcctggctatcatctacttcagtatcatcttgtagttttaactgaattggattacctattaaatagccaactcgaatgcttgtcatataacgagcgaacgctgccgctactcgattgttagcatggtaaggattattactatcttcttgctttttgattgcgttattagcctcgtagtaatcatacaaagtttgaagtcttgagacttgatgattttgatgatggttaataaactgatagacaatcttcattaattctaacggctgttctgaaactgccgtgtatgttccaactggcatcgtgtagtctcggttggcttcacggtcaaaacgttgttttccataaatactattaataatcattcactcccatctgacgaccaatcgcgtattgttcatcccatttaacacctaacgatccatcataatcccccatatattggcgaactgcataacgtaaggcgtcaatcgcatggttgtcttggtctttaggcttgcttagcgtgttacccatgcgatcactgtcaaagacgtagctgtttaattcacgccacaaattcttgcatttagggtgaacgtgaatttgatattgccatagttggtcaataccagcctcaattggcgtttttgaaacgctatcagcatttaaaattcctaaatcatttaattgagcagttctttcagggcttgcgctatctgcatatatcctggctcgttcatagccgttagcttttaaccatttagcaatatgtggtgttgtttgatgataggtatacatctcatcgtagacccacaactgcttattgcgaacatcaacagcaacggcaacgaaagcgttaggatcattaccgaagccatagtccaggccaaagccagtctgcccacactcttgtatcttatccatagcattaaagtcaacttgttcaacgttatcttcaaatactagcccttcagctacgccccagtcgccatcaacgaccgttttagcgcgtctagggttggtttggtataaactataaagccgctgtttatattcgtcagagacgaactcattgcatctaacggtagtcgtgcgaacaaaggcatcatcacgtttctggtcaaaaaactcacgctttagccaatggtgctcattccatgggttaaacgtgagcgttacttgataaaagacttgtggatcattcccacgtaacgattcaatcaccgtttgtaacttgctaaacgattcaatttcataggcttcttctacccacagccagcacaattcaccagtaaggacattaactgaagttagtttcaatggatcatcaaggccacgaaagataattttctggccagttggcaagtaagtgatttctggcaatgactcgttatacttaaagtaacgtgctaagtggaagtcattaatagccttcttgcattccacgaaggtactagtcttgttggtattggcattacgccttacgaccaagatatttgaccaatgatacttaactaaccggtaaattaaattgtgagcggtggttaccgacttcttcgatccacgactgcctttaatcactcggtaaaagtgatgatcacgccagaaatcagtatagccagaaccaattaattgtcgtaaacttaaattaaattgttgggtggttgacatatgacatcatctccaggggggacgttaacatgataatagcaataattattttatttttaggactaccaattttctttcatatggcatggcggggtttaaattggtttgtagatttcattttgattgcagcagtcatcggtttaatatacatagcttggtggtttatcgtggcgtttgtcatactattagccatctcatatacaatcaagtattttgttggccgtcatcgggcaaatcgtcagtaaagttgatgacaacttgttgattgtctttactagatcgtttagccttagcctccgcaatatctgcatcagctttaagcttgcgaatctgttgttcaacaagcttatcgttatccggataacgcttcagtatttccttagtagcgcttatccgtgttttcaagtcagcttctttgtgttcctcataaacgacgtcagcagtgctaatataaaccgtttctttagtttcccctctagcgatactagtaagtagctcaacggcttctgtggcgtccataatgcgcttggaagctatctcagccatttgctcatcgatgtaagatttaattccaacattttccaacaatttgctagattgtgcctttgcatagttgcgcgaataaccagcttcaatagcagcttgataagcattgccagacttaatatactcatcggcaaatttacgctgttttggcgttaactttcgtttcattacatatcaccacacctccgttaattggaattagattgataatcctattatttttcgagtaaacgaatccgaattgccagtacctgtgcataggtttccatagctcttgcttgaataccaatgagttgccgttgttcatcaggaatatctaagttactggcagccggccaagctttagcaatcttgtccgtcagttcattgtattcagtgtttaactttttcaacaatactttgttcataataattaccatcctttttatttttatccaaactaaaagcgccatgctgtttagcacgacgcttcatccatttatctaagtgggcatctatctccgcttcttgtggcgtgacgtagccatattttgtgttaatcatctttaccatgagttgcctcgttgcttgaacagaatggatattgtaccccaaatagttctagattaacttttttccaatcattctcaatagcctcgttgtcttccatattcattgtggttcctcctaatcgtatgtatcaaaaaagctccgcatagctattatacgaagctttctagcctagaaaatgtaatacaatttgtacaatagttggaactacaatagctacaattgctatcgcccaagtcttcaactgtcggtggtctgcttttattgtatcttcaattttttggattgtttcttcctggcttggcaacccgtcaatcttatcattcaattcttttaaactagcttcgactctatctaggctttctttttgatatttattttgattatcaataagcttttgggtcaatgcaatctgttcatcaagtcgtttattatgtgtatctataagcttatttaatgaagtatagtcacgatcagttaaaaagccattattctcagacatagaaattcctccgttcaattggtaatttacagtgtctcgagcctcatgatcttcaatttttatatttgaacttgtaacatctggattaactgccgacagattaatgggaccattgtttatagaagatgctaccacaaatgcaccaaaaatagccgtcaaaagctttttgcctttgttaaaagatgcagagtcctcataagaatcactatctgaattgaaaaaaatattgttggaagattccatgagcttaattcataccatctgttggggcagcgctagttgcgaaagttctaaacttttggctttgaatattttgaccatccaagctaaatattccattatattcgccagcttgttggaaaactacatttctaaaatcaagattaaaattaaagccgcccttagtaggctcagcgaatgatttaatgtcaccttcaactttgctcaacacattattattttcatctgtaatcgtaaacttaatatgatgatcagtatcaaaactcaatccatcagttaaaacagtcgcagaaaaagaaagtgctgtgggaacgataggcattccaagcgttagagtgggatttactaatctaactgtactgcctaaaccgttttgattatttacacgatcaatattctcagaaaaaacaatttgagcagaaatactttcttcagtcattaatcatcatcctccaaattaaataatctaagttactactatagattatacaaaaactcccgccaataagcgagagccagtttggagattgcccgtttaatgtgcttggtagggatttgcacccgacatgggccattgcccagccactaaagcatgtatctcttcgataccggttcgcgtctacctattccgccacaagcacagccaatgtaaacaagacgatgggagttcatgttatgaagttaattccaaacacgactccagccctattcagcagtttagtgacttgcttgggtcaatatgattggtgtgggccaagtcgcgaacttatttcagattcgcaactttccccgctaattatatcgccggtaggactcgaacctacatcccattgtggcttgccaattagcccacagcgatactcacatttaacggccgacgttaaatacgaagactaatgccggcggcagagagaagcgcatcaccccttataaatccgccggctacacagatagctggatttgaaccaacatagacggttttggagaccgccatcttgccaattagatcatatctgcttaatagacgggcaaccgtatcgatttaaccaaggaggtgatgtagccgtaaatttgtccccgtctaacgtagcctgctggactcgaaccagcggcaacctgattaacagtcaggcgctctaccaactgagctaaggccacaataataatcaattagagctatcagaaaaacgtttatttgtcgccctaaccaattatcgataatactaatttaccaccaatttattgctatgaagttcggttaaagtccggtttgagttcggttttggtaaatattcaggtcttctaggtaatagctctgtgcgaactgtagcattgccaatggcttccagcggtcaaaatactgcgtcttgctgtagccaatatccatgtagcacatcgtgtcgctgtaaccttgcaaatatagccgatctaatatctcctggcactcatgatcacagcgagccattgcctgaatagtctgtcggacaatctgctctgcatacatgcggcgtgtaatccgattctcggccgagttaccagctggggacgacttaggcatgccatccatgctaggcgattttaaatcagcaaccgaatggccggacgcccgaactgctttcggtaacttcttatccaggaaccgccgcacctgtttaattgttttctcctggtcaattggtggaaaaatttcatctgaaataacttgctgttcgcccatcatgcgcccctccgctttcgtatgctataattaattttgtgggaatcaattgtagcggcgtcagcattggcagtgccttttatatgttatacttacaacggtcatacgagtggtcctaatgactagtcgccctagtaggcggctttttgtttactctcgcgatcattagtcacctccacaatagtcattgctggtgtcgtccaccagttgggcatgtcatacgctgcgtccatgaagttgtcggcttcatcataggtgtcgaacgtcgcgatgatctcgtgtgaaaacatatcttggcactcatacttaattgtcatttctttttctccaatagttccggtttctcgtgtacgttgccaataactgatatacttggtgaaatttctgataataatccatatttaacgtagaatgcgccttgctcaaacttgacctcatatctattccctaacatcccccaatattgagatgtaacttcaataatatcgccctcatagatatccttgccgttcacgtctgtcaggccggtaaactgttctagcaccagattatcaggtgttattgtgcctttacgttgaaggcctgttactttgactttttttaactcgccgtcagggtaaaactcaatttctagcaccttacgatagctacttgtcgctttatcccacgctctaaatttaatcatcgtcgccatctcctatcaaatcatctagttcattaatggcctgttgaacaccagcagcctcacttttaagctcaaacatcaaacactggttgcggtccctcgccaatctcctacgcaactctttcattccactattaatttgccggtgcttccgtttaatcgttgaacgtttctttgtgtgtttaggcattctcgtcctccgtgatttcatctatttctactctaggatttcgtttatcaacggcaaattcgtcctggaatcctgtgatgtgctttcgattatcgttgcctaaaatcccagccttcataaatccgtccagcacaaactttttagcaaacgcgatattatctgcatctttccggttgttcttcgtgtaccacgtaaatttaagcttgcaaggccaattaaattcgattccagaattccgactagccctggcatacacactacataaggccgtgtaccgcttctttagtttagctgcggcgtatctgttggcccgttcagccttgatgtactcatttaggctaggcagctcgcctttgatcacgactttgctcatactttcggcacccggataatgtagtagccattaacgatcccgttagacatactggcctgtctaatcgaaaactctggagcatcaatcttctcgcataatcttgccagtgtttgataggcgatcacttcgccaggattgttatacttctcagnnnnnnnnnntttcagtcatgcgctcacctccgtttgcaatccttgtctagcttgctctagatcaataaaatactcggctggtttaccccaacattgggtcaaatcaaaatttaagtcatcccgctgatattcaataattaaaacttcgagtgcaaatagcttgtactcatgagcgcacacttcatcttgcgcgctaccgccagcctttaaatgccgtttcatgcgctgcttagtccagtgcaatgcggccggttcataggcatggttagcggctaacttgactaattgattaccccaattcatttagcttcctcctgactgttcatgaacgctaggaacgcctcgtcgctcatatcgtcctgctggtcatcgcttgagcttgacttagaatccgcctgagaagcgcctttttgcatccactttggcgtaacttctttacggcgtggctttgaatagccactaggttttctttcgctcttaatgcggtcgtcatgattagcagcagcctttttagcctgctctaacgtcgtaatatttcgtttcttccagcccgcaacaattgcacgaacgtatttcaaacatgcattagatctaatctgatgttctccagcaacccaaattgcataggcaatcacctcaggcttgaactcttccagccattcatcaatctcaggtcgggcaataccatttggaaatccccacaggttggtccagtcgttaatgacctgctcgcgtgtgacacccgcgtcatcatcataattatttactttacttttatttgatttacttttatttactttactttgtggattaatgtcgacattaactacacttgtatctttattgatgtcaacatcaatccaatacttagttggtttctgtgatttgcgacgtttagtagcatcttcataggtctcttggatacgctggctcgttaataccttagccgaattgaacagttcctcgctaaaggttccataagcaatcaagcggttaacgatttgattagctaattcaggtgatacgccttcaattcgattagctaactgcatctgtttcaatttattccactgcaagtagtatccattttggtacaccgcagacagcagataaatcataaatagaacacctttcggtccaaactcgcccataatggcttctgtcttgtcgtttacagcaaaatcaacgtctaatgggaagtaatccaatccctcttttactggacgggccatctcgcacctcctatccattattaatgggcctttcacccatttggtggattcagtcactgctgcattcaagccaattcgaatgtttatttcttatcaaatgccgctagcaacccttgtagctgactcttagcatcctctgcttgtgctattgttaggttcttccaatcatcgtcagtccctttccaatcagggacaatttgttgaataacctcattagtcactgataatggtgtgccattcttggtttgagtggccagttcaccagcaaggttagcaatctcactcgtctgttttgaactagcaatgatgttagtaggatcaaaatcttcatgtgctttatcgtcagtttcaggctgttgcttgccagctagtagtaatttagcagcagtcttaaattcaggtttctgtgcattctcagctagccattcaatatagccacgattctcattcatgacatctcccatgctcttgcctttgtttttgccaaaattaagtttcaaattaaaggcttcatcataagtcatggtttcgttattctcacgttggttaaagttctgcatatcttcgacatcttgtgtgaagacatttgataaactagcgatagtcagtgtggcatcaacctgggcccgctttttcgccattttcaataccgtgtttttcattgaaaatccatcacgagaaacgtacttgctctcttttgtgtttgccgaccctaatccctcagttaactgcataccgctcttgtacagcacgcacttgacggtgtagtcgaaataaccatccttgtagttttcaaccttatcaatgacgttatattcactggttacacccatcaacatttgaattttctcagctccgggcttcaataatgtcggcttctgtgtgccagggacaaccccaaagtcttgaccattctttagctgtttttgaaccatagtttggaaattagagatagcctgtagttcgctagccatcttgttttgatcagtacccatgattagggatagactattcgtttgattttctgctttcgcgattgcttcactcatatcggttcctcctagtatttaaacgtgaccttctcagttgccggtttttcagtaataccagcgataatctcgccatcttccatgacaaacttgtcaccaaccatgcgaccagctttttttaaatcgactttatcaatagattccttgaccttgatatattggctcatgccctgattatgaagtgagtttaaaaccatcttttcgtcatacgctaacccagccgggttcttacgagttgatacacggccattaggggtatcgattttgaacttcttgtcaactaaccgttgatcacgtaaatagtcagtcaatagtccttcgaaatactcgcggttggcttggttcttatcaagctcccggtcgcgccatgcaattgcctggtcaatattgttcttcgcaacttggccaatttcatcatcatgcgcttggatagccttgagcttctttaatgcccagtcggctttctctaatgagtcaattttgaatccttcgttttcacgctctgtcaccgttctaagttcttcttttaacattgcatccatgattgaaatcctcctatttaatatccagcaatgacgccactttcaatcagctcttcctcagtaggttcatcatcacgccagccttccgcagcttcttcttggtcaattaaccagctatcgtagccgttcattttgcccacctccgtattaacgtgactaaccattgttttagcgactgtttcggagtacaataaaaatcgaaaaagaaaattttactgtgatttttaattttagctgcacgggtactgccaatactcgagcagcttttttcgtactcaaatttaggctttggcgatacttccaattcgttcgacctccttaaatttgtcaaaaagattattcaattcttcaatcgtgatttgtttgtaaagcacgtttccaatccggaatgtaaattacatcgtcttcatctccttaaattccaaaccaactagcaacctcatgacgcttgaaccacaatgccgttagcacgcagcctactattgctccttcaatcattgctatttcctcctagccattttcttggttgactttatcgattacttcctgcaatttatccattggaataccggcatactcagccttcttagccaaatcggttatctcggcgctaatctcttctgcgtattcacgtggatagcgttcaataactagttgctgcgctggtgtccgatctctcggcttgactgtaatagcttcttcaaactcagcctcaattctttctcgctgacgctgttcctttttctgtttcatcaaagccgagaacatatcaccttgtagctgacgatcattctggaatgacagcacgccgaaattctcacgagcaccagaataattaagccaaaaatcgttaattacatttgctaacgacttccttatttgtgaatcagtgcttcttgatccactcttcaaccgagacaattgtccgggagaaacatgcgtcctatctgcaatctgctgctgtgtttgtgttttatctctacctaatgccaatgacaattgctctgcaaacttgttcttcatacctacacctctgtattttggaaatggctttatatcgcctttccacgtaattcacctataatttaaattaatcgggatgatctaataagtaatccatcatctcagctgctggaatctgccagccgttatgggtattcacataatcaatgaagccaccctgttcaatatccaaatcatggcgatgcttggttaaatatcgtgaggctcgttcggttgatttagttccgtatttatacttggccaaatctttaagcttccaagtacgaataccacgctgtgcttgctgccaggcttggaacctctcgtattcttcttcgctaatgaattggaaaccctttggagcctcatgccgaatcaatatcgtatctgacatgttcgcacctcctaatatgaaactgacatgagttggctagcttgctcgttatactcggccgttaccgatcggaattcagcatctagtgctttatcgcttagtgcctcaaacattactcttggtgtttctggtttaacctttgctagtgcattgattaaaacatctcttgttattggcttcattttgccgtctcctttgtcaatttgtatgcttttgccgatatgatacgtttagtatctttatctggtaaaaaaatatcaggaaataaaatttctggtttaacctcaaaaaggtatgagaatttggcaattaatttactactagggtttcgtgatccattttctatacttctaacagttatttccgcaatatcaagtaattttgcaacactattttgagaccaaccattcctttttctttctgcaataagtcgctcacgcttcatttttgcgcctccaatcctgatacatatcgtatcaacaactattataataaacgatactttaagtatcgtcaagtgtttttagaaactttttgtatcatagattgaaaccgatacgtgatgtatctatactgatacatgtaatatccattaagaaaggagtgatactatggcatcttcaggaattgggaaccgtttaaaagaattacgaaatatgaaagacaagacacaagatgaggttgcaaaatcaattggtatcagtagagctcgatattcacatttggaaaatgaacgtaacgaacccgacaatgaattactaaggcttcttgctagctattatgaagtatccactgactatcttcttggaaatagcgaaaaaaatcgtaaatctccagactgggctaccgaagccgatcgtattgatttagataagcttctccagtcaaatacgcctatgggatatggtggaatgagtatggcacccgaggataaggaaaaagtccgtaatgttattgagggaatttactgggaccgcttgaaaaaattacgtgaagaaggaaaaaagtaggtgtttgcatgcgatacgacacgtatcttaaggtagaacaacttgcgaaatcctttggaacgtatgatccatttgcgatagcagatagattgggattcgaagttcactttaaggacattggggcaaatatgggggtctgtactccaatattgggaatcacagatataataattagcgatagccttcgtgattcaccggccagacttccagttatggcccatgaattatgccatggcattgaggacacggcctgtgtttcttggtacacgcttggtgattatcagaaaaacagtgccgagtataaggccaatgactttgcatgccaagaattggcgaagctatacgaagaagaatacgataaattacctgatagcttcaatgcactaaaaaatgcgtacggattaccagacgagtttatggagtttttttcgttttcataatgtgagttaaaatttaatcatcattgggatttctatttggggaaatattaatttggaggaattattttggaaaatttatatagcttgaggagtatatattatgggtgaaaagattttgggattagtattaactattgtttttggatatattacatatcgattgtataaaaataggaacattaggaaagggttgcgcgtaggactaattatttttacaagtattctcacagtagcatcgttatttggaccttataccagtgacgattcaacaaaaaatgttgataaaagtgggcgtaaaactaagactaattcagctactaagactacgaacaatgaaaataaaaaatctagtagtgtagcagtaaagcataatgctcgaagtaagtcgaatgatgaacttcaaaatcaagaagaactgatttcaaatctaaaaaagacaaatgatgatggaaaagttgcttttaaggataataatattattgttactattgataatgtctatgttgttccgccagtaacaactgttggagatactgcgtatttgggtggaattttcaaaaagattaaaacggctcagaataaatttaatacaaaatatccaatagtttttaaagactccgatggtgtaattggatatgcaacatacactggcgacggttggtataaagacctaactaatcacgatggaaataagaataattataattttaaagatggaatagaaaagtaaacattagcgtaacttaggcattaacgtgcaattcaataaccttggcagcaatatttacggctacaataataactcgcatcgaatcccaatgattgtcattaacaatacaattgatgagcggacacaagatggtgtttgctatcatgaaatttttcatatacggcatcacaagggatttaatacgcagttttttgcaataaatactacaagttttttatccgatgacaacgaaactgaggccaacaagtttatgctggctatgttgaaagaggaatatggttggagcaagcaagaagatgtattagacttcttagattttttcaagctaccgcatgaactggcttcgctgatctaaaagcgctgaccagataggaagtcattaaaagctaggagttgggactacttataattcggggaattattgttattggggaataacatattttggagggattactttggatatattttttacatttatgtttcttgtatctttaattgcgttagcttacttttcaattcgtgggggaattcatcatttcacaaaaacaggtgttaatcgtccatacaaaaaatacaccttaatctcagtaggactaacaatcctattcttagcattaacggtttgggccgccccttctggcacagcaagatcgagtgcatcacagtcagatacagcctcaagtagcaaagcaaagaaaagttcagcaaaagatgcatcgaaaagaaaggctagcatcagcaaagctaactctattaaagaaaaggagtcatctgaaagtgccctatcgagtagcaaaaaagaatctgaaagtattgctgcctccaagtcggaatccaaagaagattcagagagtatagctagttctgaatctgagtcgagcaaaaaacagtctgaggcagaaagctcttcaatagctaaagccagttcagaatcattagttgctagctcgtcatcagctaaaaaagcgagcgaaacaagtaaaacagacaatgcttcctatacacaaaatggtggttggactactgctgcttctggtatggtttttgtatcagactccaataagtactacaccagcgttaaaaatccaggtaattaccaatatatgacccagagtgctgctgataattctggtgccaagccagcaccacggggcaatcaatacgcaagaccataacaggtccaagccctcgtcggggctttcacgcgagcgtagttcaacggtagaacggtgctcctttgaattgctgactagatactaacagatgtaggttcgactcctgccactcgcattgaccagtcaagatgtcatgaaaagctagaatatattttcaggaggatatttaattgattcaagaattcaaagaatttatctcacgtggtaatgtaatggatttagcagtcgccgttattattggcgctgcatttactgctatcgttaaatcattggttaataatttaataaatccactaataggtgtttttttagggcaaattgatttctctagccttgttttaaaagttggcaatgctacttttaaatacggttcctttattaattctgtcattaattttttgattattgcatttgtggtatttttactagtcaaaatgattaataaaattatgcctaagaaggaggatgtcgaagccgatcctattccaacagccgaggaaaaatatctttcagaaattgtatcattattaaagcaacagaaaaaataattgtagtaagaaatcaggtgtcatttatggaaaaatcagaagatttatctactaatgattggaaacaagcacagtctgccgtcttcaaagagtacgaagattttattaaaagagttcaagaaaatggtgtagactatgctattcagcatgcaagacgtttaataaattaccaaaaattagttaccgaatggcaacataaaacaaatattttaatggacgatctatctaataaccccgtcgctttaagtgtttttaaagacttagaagaaggaaacgaaagtcatgttttgagtagagcttacgagattatgaaaatgtggccagagtttaacccagaaccattaaccatttggctagagctcatcgaagactcagatgatgaataataaaactaaatgtcaaaggaagaatttcaaatgaagattatcaacgtcgcattgcatgttaaaccagaactcaaaaaagaatatgaagatttcattcatgaacttgttattaattcagcacaagaagctggtaatgaattctatggacatttcaaaaagttagacagtgataatgattacgaaattatcgaacactggaaagatcaagaagccgtggatttccataatgacacccctcatttccagaaatttctagcacacgtcagtgactatctaacttcagaaccagaaattaccagaatggattattagttttctcgctttacaattaagtaaaaataaatagcacttaattgcaaagcttctggacctttagctcagttggttagagcagacggctcataaccatccggtcgttggttcgagtccaacaaggtccatgacgcgagtgtagtttagtggtaaaacgacagccttccaagctgtagtcgcgggtccgattcccgtcactcgctttaaataaaataatttattttaacaaaaatcaaattaatattgtatatactaatgcggggattaaagtatgaataataaaggcacttttgaaattttaacaattccagatgacacaagttactggttagttcgtgctgatggtggaaaatatctagatgactacattgaaaattctttcatttcgattgcacataatcaggtaactatcgagtcaatccactccgatgatagccccaaagatggtctaaaaaacccagatatccatcaaatgtacattgattcttatccccatcaaaccaaacattggcagacgattgcctcgtctcaatgttttgaatttattaataacatgaaaattggagatgttgttcttacgcctggtaaaagttctgattattttgcaataggtgttattacaggagatccattcgatgctgataaatcaaaattaagaacaaaaaaagaaaactccggacccaatggaattcaatataaagtcgatcaaaatctaaaacggcgaaacgttacatggatgaaaacaatacacagatcatcactccccggcgaactttattggattttgtctgcacatcaagcaatttttaacatttcaagttacgcggaatacattgatcgtttaatatttcctctttttcaaaaacataaaaaaattcatttaaccgtctacaccacattagaagacgatttaactcttgcaaattggcaaggtattgtcgaaatggcaaaagacgaacagtctaattatttacaccaagtagaactacaagcagacgttcattgtccgggcaccttaggatttataactggtcaggaaaacatacaagcaattataaacatcattcacacagtagctagtcttggagggaatcaagtaattacttttggtggaattgttactttaatctctttagtaattgggaaagaggggaagaaaaaaggcattctgaattggtgggatgattaccgaatctcgcacatacaaaagaaggccgaacttaaacgtctcaaacaagaaacaaaaaatgttcctgatgaagtgaagaatatcaaacctcagatcaaggatgttggaaccgtaatttcacacgaaaacctaaaatcgaaggaaaagccagagaatgatcaggaaccagagaaataaatattggaataacaagaatggaaaatatccaaatggcaaagggaatatagctatgaattagcggccacagtattaatgcaatgaatgtcgactccattgacgttaacataagatatgctactaccttcttcataaccttcacttcctttcttccacttacatatgattacacatatcatatataaaataaacagcactttactactttagtgcttttattttagcacataaaagaacatacgtttggaaatgtcagcctattattatttccagttgggaggaataaaacatgtcagtaaccaaacttaataatggtaaatggcaagcccgtgtctcttataaggatgatgacggtaattataaatcggttacccatttagaaaagcgcaaaaccgacgctgttgagtgggaaactaaaactaaaaatgctctgctggaaggtgctgacttatcacgtagcactgagagtctaaagcactactttcttgattggatcagaatatacaaaactgacggtgtatcgcgtcatactcatgagctgtatatgggcaattggcgacacatctccgcgtattttaaggataaacctatgagctcaattaaacggccggattatcagaaatttctgaatgaatttggtcgcagtcatggaattgccacatctcacaaacttcatcaacaagtacacaccgcaatcaaggacgctgtagccgatggtattctaaaacgtgactttgcttacaaggcacacgtcaccggacgccctcctaagcccgtagaggaaaagtatttgacgttgtccgattataagaagctgcgtaaatacctcattaaaacagctgattatgaccacatgactatgctaatgatgctgtttcaactagaaactggaaccaggttcgaggaagctgctggcctaacgtgggataatttagatttgaataatggaatagttcacattaaacagcaatgggatgcacgtagacagacttttcgtccaactaaaggaaatggacaggccgatggagatataaccataggacccgcctactgtcgttttatgagggcctatcgcatcacacagaaagattatttagaactacacgaaatgaagaatcctaagaacctcgtattttggtctaaactaggaaaaatcgtgggcaatgggaatgcaaacgaagagctaggacgtatttgtaaccgtctaaagatcaacaaagttacaacacacgccatgaggcacacacacgcttcgattcttatcttaaatcatgagtcccttccctatgttcaacatcgtcttcgacatcaaaaactagaaacgaccgttaacacctatgtccatcttattgaagaagaaaacggcgtgtcagataagaaggctaccgagctaatggacgaaggattttaaaaatgataattttatgattgctgtagtccttgtgccgcaagggattacaaaatcatttgttaatttttcttccaaaaactgctatattttggctacttttttcatttttggaagaatcgtggaagaacatatcgagtttgagtggttttcgagtgtaaaacaaaagcaccaaaacgcctttatatcagcgttttggtgctttgtcggttctctatatttgtcaacttatcacccgcacggggatcgaacccgtaactccgccttgagagggcgacgtcttaaccaatttgaccagcgggcacaaattcatttattatcttaccgaatgataagcggcttgtcaaatataattaagatttttgccacctaaaaatcgtcacaacaactaaaccaacaaataagagcaaacagtaggccacactacaccaaaaaacgaaagtcaataattgcggtaacaaaaagctgcgcataactgctaatccgatggccgtgaccgcccatacgatcaattgttgtcgcagatgatcgaataaatgatctaattctgacttcgacatacactcaccttccattcaactagtttagccaccaactgatacgatattcaagcaaaaatgcaaaaaatagacacaaagtttcagcaaagtcttgacagtatttgctggaaaagttactattaaatagttgttattgggtattcgccaaattggtaaggcagcggactctgaatccgtaatttactggttcgagcccagtatacccaatattcgttatcagctgttatcattggttgtcaaaaacaccgtgattacagcttttttattactctagtttgtcattggttgtcatctcttttcactaaaagtcagccaaaaggacagccaaaaatataacaaaaaagccactgtttccagtgacttaatacttgcgcggggcagtgactgttagccaactttggttaacagtttttttattgttaagccattagtctaacgcttattatcaaggcaatgactgcgatagtaatgtgtatcacaaaaataacctttcttatagttttaggttcatgataatcagacggccaatgcaaaaaatcaagcactgacaaaaccataaaattaaacgttaataattttattccaaaaacaggtaccggcgtagataaacataaaactatggggccatcttgaaatatgctagaaactatcaaataagccggaacaattaacaatgtaatatttaaagtaacttcaaacaaccatttttttataaaagaactcatttacaaggacactccatcaaatatttaactgcacattattaattatacagtaaaattgttgaagtttggctatagcaggcattcaaaccgttagatcactgtaaaattttgcaaaagcgtgtaatgcttcattcttcatataattaaacttgctgacactaactgataatcgctggcaagcctcgttgcggctgaaccgcttctcaatgatgtaatcatgtaagataaattgatattgtgggtcatcaattgcattgagggagtcttcgacttcttttaactggtaagataagtcaacatagtttatcaggcggctttcagtgccgtttcggctgctatggcttgatactccatcgagcgagggactagaaacctgattaaaagccgtgaaatcacgttttagtttggcatattgctttaataaattgcgaattttcttaacatcttggcgcattggaatcacactttctaattccagatatatgtataaaaaagaggctcgggggagagcctctcactataggatatgataatcgccgtttttataggaaagtaatattagggcaattacaacattaactctagtatcaatcatttcatatgtcaagcctaagcttcaatttttccacgcagttgttgaatcatactaacaacttgatacggtgtttttgtcatatcagttactctgttttgataccagaattgtgtcagcaaggacacggcaaaatcgtactgtttgtagatagtcaaatcctcacttttgctaacggccgtctgaacatagtcctcggcggcgtctaaatagctttggatcattggatcatcttcggtcacatcaattcgcaggcttagtttaatatcatcaacggttacagccatgtaatcactcctttattagggggtaacgaatcgtgcccccttagttttaatttatgtataggggggtgccaaatcgccacccccttgtataaccgtgcccaaaagtgggtacgattatttaccaggcgtggtttttaacgccacgttgattacagcggtcttatcaatcactttataatcgttccgcacaattacggaaagcccttgactgaactggtcgaacttgtcccattgggcggttacttggttacgccggaaaaccgccaccgcttgtgataagtcccccgcaatcattggggacgtcccgtcgacgttgttggccagtaacttgtcactaatcatgacgactggcgcccctaacaaggtaaagccacttggtgccgttgggttcggttgtaacaggtaacggccatcggaatctttcaaggtatcaaggtagttgaacccggactggttcactaaccacattttgctcaaagcgggatctaacgtcacattgaaaacctttttaagatcatcaatattggtggccgttgctttggtgaaactggttcccgttaacaagctcataatctgcgtgttgtccgtgttatcaaccaattgttgtaattggtttttaacttcactgacaatatcaacttcggcgtcttccaccacttcgttagataaggcaatcttacccgcccgggtcttcacatcaaacggcacttccgtaaacatgttcgcgttaacgtcggcaatgtccgctagttcttccttagtagccaataccgcagattgtcggctagtagcaattggataagtcccggaaccactagaaacttgcttgactgtcgcatattgggcaagattgtaattggattgcttcaattgggaaacgggggtaatcagttccttaggaataaccgcactgaccccgtcagtctttaaaccgtcccgtgtttccccgtgtgtccgtacatattgttcaaatgccggaataccggttttgttttcattgccattaggatcaataattgtttgttttgccatgttgtcaggctccttttcttggttaataaatttttcgtagctacgagtatcaacttgcacattggtatcgtcataagcgggaacggctaccactgacacatcgaacaaactcttaacttgattaatggtgcgcgtgatattgccgccatcatctttagtccattcgtcggtgtcgtcgtcactatcaaagccaaatgagcaggaatcaacgttcccgctttgaacttcttcgtagacgtcattagcaaacgacgtattcggcaactgtgcggtgaaatgtagccccttgtcgtccgtttctaacgttaatgtgcccgccttggcactggctaacacttgggtatagtcgtggttattaagcataagaacgtttgataaatcgacaccatcaagggccttaggggtaacaacctcagtgaagccgcctaagtctttacttggtgagttccatacaattgcataaccactaattgttttgcccttgcttgtttgggaatctttaggttgcgggtctgctgaattttcagctggcccgtcttcgggtgttgctgactgcggcgtttgtgctcgcaattcggcgtcaatcgttaaccgtcggtcttgtttcatgaattagtcactccattcttttgtaagtttaagaaaatattgccatcgtcagttggtggcaagccaatcttggcccgagcttcgttacggctcataacgccgccagtgaaaccagccaccgcttgggcttgttgcgtttgcggatcaaggctcaatagcttgtccgtattaaacgtaaagtcatgaccaaacttgaacgacagctcgctggtaaagctatcaaagtaatgttgcaacgtcccttgtagatactgcacgccactttgttcttggttagaatgatcgttttcaacccctaagcgctccggtggtaagccaaaagctttagcaatttgtcgggtcgtccagtcattagaattgaccagctttaacacatcggtatttaaagataagttgctaatatccatggtgtcgtcagtcacaatcgtattgaccgcattgtcacccgtattggcttcatcaaactgtttacgaatattatccttggcttccggccctaaatccgattggtggactttaataatcgtggtgccgtgcacaccagcagtaaaaaagccggttagcaatttattgccggccgactgaatctgacgctcgtctttgagggcatataggggactaattcccgatacaccgtctttggtgaaatatttaaaatgtaaaatgttgttaggcgcaatctgacgactgttgccgccaatcggggtataggtgtaggtcaacgcgccgctcacatcgtcttgctcaaccgtcatttggttgttttgcacaaatttaagtgtgtgattaggcaaaatctccgcaaaactattgccattgagtaacaggttagccgccaacgcatatttaaaatggtacccgtccatctgactattgggattctgattaatcatcgtgttaaagattgccgtatcacacataatcggattgctggcaatatcgctcgcaataatattaatcgccgcgtaaatgtcactattacgcaacaccgccgcactcacaaacgtatacgggtcgttacttgataaactaaccaaggcgtcagccaccggatcatgcgtgccactggtggtattgcttttaacaaaaaaactcatttaatcacctctttgcttttcataattaattagcaaggccagcagaatcatggctataccagccaatattagccccgcttgccagctgatccagcaaccaaaaccaatcactaagcatattaagccaatcaccaacaagatcgtttgtacataatcagaacagatctgccgcagtcgctgttttgtagtaatcttctgcatgctgttgatcctcactttcttggtaatagtccatacctgctacaaacgcgttaatcaacgccgcaatcgggtcaatccggttactgttgcgggctttatccagttgccaaccattgtttagcacttttaagatggcgttattgaccgcataagcgagaatcttgttgccgttatgtttaattttgtcatcgtaaagctgatcacggaaattacgagttggaatattcaaagtcttggtgccttgtcgcacttcaaacagtgggtagcttaatttctcgaattttgtaattaacgtttgcgcgttatacgggtcataagcgattgctttcactttccagttgtatttcccgaccagtttttgtacaaaatcaaatagattgtcataatcaataatgccactatctaatcgggtgatactacactcacccgcccgttccattgaccggtaatcaatgccatcacgtttaatcttagaatcaaggccgtatttagtccccacaaacgaatgactgtcacaataaaactgaccgttaccaattggaacaagccaactaaccgcggttaagtcattgctttttgataaatcaatgccaatataggcgtcacgattatgtaagtcgggcacctttgccaatttaccagcggcccaatcgtctgctgaaatataactatcctcgctggcttgcaaccacatgttgaagttcttaaccagtattggaatgagattattttgtttaatggcaagatctacgtcggcctgaatcttttccgtcatgcgttgtttaacgtgtggttcactgaataacgggttggccttaatccaattggtttgatcgtaaacttcttcgcggtcgtccagttcccaaattgccacaaaataacggtcagcttcggttttcccctttaaaacgtccgtcagcatgtcatattcggcgtgcattggaacgttaaggttaagacccgaggtggaaatcaccgccagcagggagttatcttcttgtgcttgaccagactttaaaacgttgtacactttgcggtctttagcttcgtgccattcatctaaaataacggtagtcccggcataaccatcaagcgtactggtatcactggcaagggccaaggcttgcgaatcagtttctaggtcggtaatggcttgtttctgtaccttaatccgttgccgcatgtacttcgattgtttacggacttgccttaacccacttgaaagcatgtcgtagcctaatttagcttgtttaagggcgttgctgacgaataatacttgtcggttgcgggcgggctgacgttctcttaaaaggccattagcggccatgccagaagccagataggttttaccgttcttccgggccatactaataaacgcacgatcataacggcggttaccggtagttttttcacgccagccatacagctcactaataatccatttttgaaatggttgcatggtgagttggctgccgtcagtcttaggcattaattcgataaatttgaccgcctgtgccgctttgtcttcgtcatagtagaacgggaagctgtcgtccttagaacggcttaaatcgcgtttaaatcgctcacacgcccatttaatcttttgacaagccagcactcgacccgataaaacttggtcaacatattcaatcatgataacatcgcctcaaaagtatcttcgggtgtttcatctttttgcttgtttaattccatgcgcgcccggctagataacgacatgcctaaatcattggctaaggcttttaaatctttcatcgcttgtgactgcaaggccacgtaagggttcggcttacgtacgccagtatcttgattagtttgtaccagtccgttcttacgaatatcattctcacaagtctgtaccgtggcataagcgcggcaataactggctaacatggcccgatcaagttcactaattggggtattggcctttaaataaggcgctacccgttgccattcagtcaaggcccgatcatgtaaccaatctggcggggttaaatcaagcaccggataatcaaataacgctttttcagcgtctttacgttgatcacgctcatcattggttaagtgtttcttcatactagctaaggcttttactttttggctcattcggagcactcctttcgtttaaatttacgtaccaaaaagcccccacgggttagacccatagcggctgattgatacatatatccagaattcgtttattatacctatattatcgcacatatctctaaaaagtacaattaataacatgtatatatttacacgttaccccctgactgactatttgtttaaatttcgcattattagtagggatatttcacaaaccagcaaaataagcaaaaaatcaaagttcaaaagggacttttataaacacaaaagtccgctagttgctcatttcgagtcgaccatagccccccccatatcaacgtttctgggctgtcatgctattttgaattagtctcgtggctcaaaattgagccgccaacttgaattgttcactcggccgaaaaataggcgcagtccattgccaattttggcaacgttgacgcaaaatgcgggttggttaacttggtcgaaaatttcgactcagtagctcggctgaaagttcagcgcagtattgcgcagatctactactgtggaaataccttttaatatgaatcttgaattgtgggtataaaattgcgactcacaaattgttttctcgctttcacgtgatataattaacttaactgtcaggttaattatcatagatttcagcggtcgccttaacgggcggctttttgtttacctatctaagttaagcttaggtagcacaagcaacctgtcacgtcatcttagcgagtcagctagtgcaccaagttagtacgttatctaaggtcgtaacttgcgaccacagatactaaaaagcgccgcacctttcagcacgacactcattggttatttagtttgttgctcccgttgttctctaaccagtctagtcttccggttatggtgtctatggcaaagactttggagattgctctcatctagtcgccgggaccaatcgtctttgatttcaataacatgatcgaccacattggctttacggatcaccccatcttggtagcactgcacgcataccggattgctttcaaggaaccgccgtgacaacttgcgccatgctgacgacttgtaaaactgctggtacctgctctcgtcagaatcgtacatgcgtttgtgatatcgccacttgttagtggccttgcggtgcttctcacagtagcgtgtgtcataggcaaccaacgtccgacaacccgggtgctcacattgcttcattggcttagccatgaccgttgaccttagttagtgtgaccacgtcataggcattcagttcgctatcagaactaacgccagcaacgcgatacgtaaccccatctaatattgcctccaaggtcgtcgtgattcgatcgtcatggcgtaccacgattagctcgttagttgtcgcagtcgtaccagtaaggctaatggtattactgacagttaacgtgtactcaccataccagacagtgaacagtgtcacaaattgttgcttggttgtgccgtttattaggttcggaacagacttgacggtgccaaactgtacccgcttatttaggcggtttagattatagttcttcattaactaacctcacttgtaaataatcatggcgcaatattctgcagaagaagaatctaggtctgccccaaacgcgttacttgaaaacttaatgtcaatgacattgtcactatcaatccggttggctaattctctgttaattgctcggtctaaatcttgtacagacattcgcataatcgtttttgttttaatcattatagttagatcctttctatcatgttaatcatctaattgttccaacatcttgtacgcatttttgcgttgttcttcatcgcttaaaggattattcaaaacttggcttgaaacgtttcggataacgtaggcgtcagctaaccaaccttgacttgatttcataaagtgatcgtcactaaattgtgcataaatggggtacatgagttttaagtctcttacagtttctggctcatattctccatcttcatttggggtaaagctcccaaccaatcctttatcttttgctttttgagttggctcaccattttgatctaaagcaccttctttaatcaaggctctgtaaatacacgattttaattcattaactctatttgagacaactggtccatattgtttaacgtaaatgtcaaaagcttgctcaactaaacttggataaattactttcatttttccttttcctcctgtactggaaatgtttgttttaacgtggtacacgtggtacacgtggacaatcgttgatatagcaacgtttcaaagtgccctaacgtggttcattacccggtacaacgtggtacacttagcattttcgatcattgtacgcggacatatccacgtggaaacttgccattcattctaattcttttagcttcccagccgtccatattgtccattaatagcttgattcgcttagcttccgagtttgttcgcccggttaaataacgatcgactgttttatggaagacaacttccatgatttccagagttgttgtttggttgagtagtttccgttcattactaactttatcttttagccacttagaatgatggccgtagtcactgacatagctttgttttaagccggtactcatattttcccaatctgcgggaacttccattgctaaaaactcttcgatagcatcgcgcatagggtcgacagcttccgcagccatctgatacgccttagcctctttcatagtggcctgatccagatatagcagttcaccattcctaaaccagtacgcggcctccgccaatacttgaagcatgtaattctcgtccgggtgccatacatctaatttggccttgttgaccccacatttaattggataaaagcgccgttcaccggttgcgtcctttaaatagtcggtttggttagttgtgccaataaatacgcatttacgtgggtgcggtaacgcatagcggccgtaactattccggtatgtgtcggattgtgcactaatgaaatttttgattccctcaatatccgtcttcttcatggcggaaagctcggcaacttcaataatccaactaccttgtaactgttgataatcgtctttctgcttacccattcctttcaacgaatcattgaatttatccgggtatagatttttaccagccgtactcttgccaagtccttggcttccctctaagataggaacaatttcaaacttaactccgggaacataggcccgggcaataagaccagttagccatttcttagtgatggtgcgggtgtaatgattatcttcggcacctaagtaatcaatgaaataacgttcagcacgtggctggccgtcccattctaccgcttcaatacgagccttaaccggattgattgtcttgcggcgtgcctctgtaactaccgcgtcggtaatgttttccttgctgaataacaagttgtaatgatcctcaatataacttctcaataacgtgtcatcactatcattccaaaaaccttttttgaacagtgaattttctgcttgtggtgttttgacaatttgttccgagaactcgtcaaagacaactagccctttcaacatttcgtcatgttccataattaagcggatattgtaaagagactgtgttttaattccatcgtccgaattcttcttgaaatcgttctgccaatcagcgtcacgttgcattttgataacattgttggccgcttctcgtgcctctgctggtaaatccattgctttgcccattaatgaacccccttactctctcgttttaaaatggattgaaaaattacattaacttctttgcttggcagtgccggatcaacgaacgaatcattgatcactgacaacatgttatagaccgtcttaggattggcgccgacaccaaacattcgaccagcaattttagttaaccaagcgttgcgattgccctgggttgtcccggttaccatttcgtccagtaattttccagtatacttcttttggtgtgtggtacaggcgtgttctgacgaccagttcactttttggcccgccaacttatcgactaaccattgaggagctggcttaatatcagctaaggttcgaccatctaaaggttcatacattttgccgttaatttcacttggtgcaatcaccgtgaagtcacttagcaagtcaatacctggccaaacgtcaactttgcgaaccttagcacccgcgtatttcaaaaagtaatgtactccgccgttagccgtccgctcaatgtaggtatcattaggtaatatctgaccttgtttgaataatcgtgccaaactagtccggccgtttttagttggctcgtgcatatcaatatcaacaaccaataaatccgataaatctagtcgcaagcctaagttgtaagtggggtgctttttgaaccatgcaaagatggtgttctggtcactagttgcggcttggtagcccgccacccctttaggtggcttcttcgtgttttcaatcagtgggtaaaccgcatagccttgctgggccagctcaatggctttatcaagtgttgcgaactccttcatttttcatcaccagccctagcacatttaatagttaattcatcagtagcatcagcaattttaatcaactcttcattgatcgcccaggtcaatgaagataatggtcgaatttcacgttttaagttgtattgaaccatactgctgttttgcttgttttcttccaatgaatcacttaaactatcaacaatgtcggaaagtgcttcgtgaagtccaagagtttttatgatttcaccgcgtaaatattcaatatccattttccatcaccgcctaatcttcgggacaaatgtcattgctaactgccataatcgaatcagcaacattttgcatgttttcaacaacgtttccagcgcggtggtttgagaaaaataattgtcctgcccatgtgtccccactattaactgacgcagataccatatctaagtaatcaattgccatttgcagattgtcacgtgccactgataaattcttagctcgttccactaattcactatttgtcattttccattctccttattcgtgttaaaataagggaaagcatatttttgattatttctttctgacctactaccttccaaagtaaagtaggtcttttttgtatgctttcccatgcgactgacctcacactccaaaataccgacgtgggttcttgattaacttaaccaccacgttgccgacaaacgacacaatcataaacttgattgcccataagattgttgttgctatcatgaaatcacctccttaaatttgttttgccccgcccaaggccttattttttgtgtgtctgcatgaatttatctgcgtctaattgatcaatacgcttagtaccgttgatgataataactggtaaaccctgattaatgtatttttttaaagtattacgtgatttaacattgagatacttacatgcttggcctaaattcatgtacttcatttttcaccactccttattattttgtgcctattgagaaacatatctaagtcgttacgctcgatcctccggttctttccaactagtattactgggagcccttgatccaaataatttcttttaaaggtgttatagctagaaattttcaaatactgcatagcatcttttatggtcataacattttgcacattattcacctctttcggcttttttgttcaattaattgaacagttaccattgtattacaccattgttctaatttcaatctttttatatcaattattgattttttgttcaaataactatacaatttcaattgaaagagaggccattaaccatgctcagaaataacctatctgtattactgactgaacgacaactaagaataagcaaagtctcgaatgatactggtatctcgcgaactactcttacatcgctgtcttctaatagttcgaagatggtccaaatggaaaccgtaaataagctttgccaggcattggatatcgtacccactgatttttttgaatatgttcctttcgactttgattacacatttattgaaggagatctcattcccgattctgactatgctaatggaaagccagaaacacatgaggcatcattgttcattaatgtaagtgaaaataataatcgtattgattcaattgagttacaaggctatacagaatttttagggcactacgacgaagatagcatcttaattggtaccagtcttctcccttctgatgctggtcaattgaaaaaattgaatacttatttaaacaagatgtctgtttcctttgtttcagatataaaaaaagacattgaaggggttgtagagtctgcacttaataaagacagtaagattaaagtagaacccgaccttttaattgattttgatgaaactaaagaacaatatttcactaaaataaaaaatcgcaattccaatcactagttcactacgaattgatgaataatcaataccgttataatcatttccgtacataacactgccccgctcaaggtacgttatggaggaaattataaatggcaacaatcaagaagtatcaggacaaggacgggaatacccgttatcagtttcaagtttatttaggtgttgatccactaacgggaaaaaagaaaaacacacggcgccgtggattcaagacaaaaaaagaagcccagattgtattatcaagacttgaacttgatatttacaatcatggactaccaactaaaaacgataatacaatttttaaagatatttaccagctgtggttcacacaatataaacaaacagttaaggaaagcacttgggtaacgactcaacggctgttccgacttcatattttaccaatatttagtgattaccggattgctaaaatatccattaaggattgtcaaaaagccataaatcagtggtttaatgctggcttagtaaagtatcatactctaatgaattacgttgccaaggtgcttgattatgccatcaacattgacttgatcggtgagaatcccgccaagcgcgttattgtgccagtaaataaaaatgatcgttcacgcaaaaacttagaaaattactttgataaggctgaattacaacacttctttgagtgcctgaatgatgatgacaatacaccgcaagccaatgtattctttcgtttagcggcctttactggtatgagaaaatctgaaatgctttgcttagaatggtctgacattgattttagcaatcacactatacgggttaataaaacacaatcccgtggtgatggtgcccgtctgctagtacaagcgcctaagacagcgcgtagcaatcggacggtgtatttagatcccactacggtcaaaatattgcaacgctggcaagttgatcaaaaagaatggctactacgtttcggattcaacattaatcagggtaaccactatgtgtttgccaatgaaaataacgaaatgtttcaaccatctaagccacgtaaatggcttgaacatactctaactaaatatgacttgaagcatgtcacggttcacgcattccgccacacttatgcgacacttgcatttgaagcccatgcttccatcaagtcagtacaagaccagttagggcattcaagctatcgcacgactttagatatttacaccgcagttactgccaagcaaaaaaacgaagccactgaaaaactggctaattaccttaatttttaatatttagactgctgaatttgacactttttgccaagtgtaccacgttgtaccgggtaatgaaccacgttagggcactttgaaacgttgctatatcaacgattgtccacgtgtaccacgtgtaccacgttaaaacgaaaagtttcagctccagcaggaaatagggttaatttaatggtagtcagccaaaaggacagccaactcaatttcttaatggcctgaacgcctcataatagctggtatacaagcatttttgatgatataggggtcgttcccagtatacccaatcagaagtacggataaagccacgcaggtaagttcaaatttacctgcgtggctttttatgaattgtcacacccttgccagtgcaattttatcttttttcactcaaaacggtttacggacttgattaggggtttataatagatagtgtagactgtctgtgaagccttgtaaaattgtcactattttaaattcaatccaaaggagataatgttgttggtatacaaagatgtttttggtatcgatcacaatgattgtcacattgttcagacgcggcacgagtttaaccggatcttcattatcgaaaatgaagttggctctcgctttacttgcatcaaagatgatgccccactcgaaaagaagatgtctgggcactggaagtatgcaaaagctagcgacgcccctaagaactatgccgttccttataaggcccagaaaaactaaacaaccgttgaaaagaggattacgatgcggcgctatcaaccgttaaccaaatcaaatggccgggtcccccactcgctcaatcataacaccaacccctactatggtcagcatggtgctgattgggtcaaagacacgaatgcttcgctatttaatgcccaacatgagcatctccaatcaaagagccatgttgagcgacgcgtgcggcacaacgtccgtcaagtgctgtgggtggtcgtggcgattcttgccatgttacttggtggttttatcttgttctcattagcgatcaatatttaacactaaaaagagtcattcagcttatacaagttgaatgactcttttttactagcctttaatttccttggtatccactaaaactttgctgaccatccgaagctcatcagttaattcagaggttcgaatccggccaaattcgtcgaggaacttgccaaggcgttcttcgttaactttttcaatgacccgtgctaacttctcacctttggcggttaacgttagataacggtaccgacgatcataaggatcgatgttcaacacaatcaagtcattgttgatcaagtaggtcagtttccttgaaatcgctgaagaagagacgtggcggtcagcggctagctctttcaccgtaatccggtgatcagtgctatggtcaagatagtagagaatcaagaactgttcgaacgacacgtccgcatcagtcaccatcgtttgaataatctcgcgaagatggctttcaagccatgacatgcccactaagactttttcgaacaattccgcatcgtcgtacttggccttcttagtattagtcttcatcattatttaaaaccccattcatgcgtcacgttcaaggcatcatcaacaaccccgtgattacgcacggacttctgcagctggcataacggtgatttcaagatcacgtgtcatttgtttctcaatcgcagtctgaacatcacgatccgttacaactaagctcgacaacttactctttccgttgataatatcttggacgtgttgattatccaaatcatcagcagagacgattggtaagagatggaaattatcattcgttgcttgtaagcattggtcgaacaatggggcgttaactcccataaccaacacactgttttgttgttgtaagactgatgccaaccaccagttcaataattgtgcttcagaatggaagacattcgtgatggcttcttccttgttcactaattgaattgataattcgtggttactaccatattgcttgaccattgctaaagagtggtctggacgatagaagttttctagtgtcacttgtgagttattcgtccggtcaaggtactgagtgactgacaagaacccggcagcatcgtacacatcccgacgagttgctaatgacccattgaagtaagtcatgtaccaaatggcaccattcttacggtacttcaacgtcataattgggttaccgccgtcatcggcaattgacacaatctgcttatcagcattgcgcttatattgccatgcaggattatcaggtaattctggtttagtcttcgcaacagcacccggtacctttgcctgaatcgtgtagtacatgttgtacaagccagttcgtttatcaactaagccagctgattggtaactgttccaaatttctggcaagctgtcattatagttaaccgtaataacattagctttatccttaacttcactcttcaataagcccatgatcatttccatcgaagccttttcatcaccagacaatgattgaatcagatcggtgctgaacaagaagtacttcgcagactggtcaaattcgacgggcgatactaagtgagtcgtcccgtaatccgattttaacttggcatcaatgctttcaatcttttgttggagccccttaacaatcgtggcattttgatcataatcatgttgtaatcgattgattttctgattaatcaagttgagtgaacgttcttgttcgtcttgagcactcttcttacgatcataagcaactaacgcatcttgagcggtatgtaagtctttttccgcactcgtaatcgcgtgtttcttccgcgaacgttcacgggtttcagtctgttcacgcttctggagtttcacgagttcactgttgattgcgtcactcttttgatacagatcctgtgcttgcttctcctgttgcttcatcaacacgaataacttcttaagatcctgttcgccctgaattgctttacgcatatcagcttcattttgcttcaaatcagctaatgattgttcagactgcgtaatcttcttttccaacgatttgatggtttgatcgctcttagcaagagctttcttagcatcatcataacgtttttgagcagcattgatggtcttgaccattccctgccgttcgctatcgttcgtgttaacgactttgtcctgtttagacagagtaaccttagcgtcctttaactgttgttctaagtttaactgttcggcaactaaagtttcatactgttgcttttcgtgcttacggtcctgaaccaattggaccttaagctccccacgtaaagtttggtattgcttgtttaagtcagccatttcgcgttcaatggccacactgtttttggctgctgtttgggtagcacgccgttggttgacccggttttggcccttaactggggcactagttgaagcagtcacactgctactagttggccggacaccagcagatgaccgcacattgggggtcgtactactttgagtcgcctttggttttggcttttgagcagcaacggttgaagtcgccgttgcacgctcagaatgattacggtaatcctcattcttatctctgcgctttttattgaacatcttcataatgcaactcctccataaacttgattgtttgctcaaagagtagaaaggtcatcgctgacctttctatccgttcagcaaataatcaagctattctaattattatgcttcatgcttccgacgagaaacgccaaagtatagtgctgaacccatcaataaggttgaaagacccaagacagccaaggcagtcccgttttcgtcttcatccgtttgtggtaacgtctttgcgtctgaagtcgtcttagtcgtaactactggcttcaatgaggctgatgcaggaacaaccccactagtcccattgttagtagtagccgtcgtcgttggcgttacttcatcatcagaaaccgtggttgctggtgccgttgaagtagtcgtcgttgatgaaccgttgtttgatgatccattaccattatcaacagtatcgtcacttggcgtcgtaacaggagcagttgtagttgtaccagtaccgccaccgttgacgttgtcaccagtgccaggtgcagtcgtaggtgcagttgtcgtcgtgccaccaccgttattaccattgtcgccggtaccaggtgcggtggtaggtgcagtcgttgagccgccgttatcattcttagcataagttaaggtgatcgtcgcgtcatcagccaccgtaccactcaaagcaccatcagctgacttgtaagtgtagccagcaattgaaggtgttgcgaccgtgtaagtgtccccaactttgtaagctgtggtcgtcgcactcttgatcgtattaccatctgcgtcaacatagttaactgtgatcgtcttagtctgttcagttggagtagtgccaccgttcttcgtgtaaacaagggtaactgtgttaccgttgtaggcaatcgttccggcaatggcatcaccagtggcatggtcataagtgtaaccagcaatttctggttgaccaaccgtgtaagcttgaccaacgatatattcagttacgctggatgctttgatggtgttcccatcagcgtcaacataattgatcgtcaagttagctttattttcaactggtgtcgttgaatccttggtgtaagacgtagtttaccgtaaccgttgattgttcaactggggtggcattcttagtgtaagttaaggtaatggtcttattgccatcaaccgtaccagtcaaagcggcatcagctgacttgtacgtgtaaccatcgattgttggtgtatcaacgttataagttgagccgttatccaaagtttgggtcgtagcggccttgatcgtcttaccagattcatcaacgtagtttacagtaacatcggattgttcaacaactggtgcataaacaaaggttactgtattagcaccagcaacaagcgtaccagcagcaacattgccggattgaacatcaccgtcaccaatcttgtagcctacgtaggtatagccatcaagacttggagccgtcaatttgtaagtaccaccagcacgggtaaatgttttgtcagtaccttgagtatatttattaggcgtagccaacgttgtcccatcagcagtctgatagttagcaacaataccagtattttcggcgtagaccaatacaatttcattattagtagcaaccgaatcgactgtaccagttaagccattgtcaccaggtttaacgttatcgcttgcgccataaagggcatagccatcaattgttgctggattaatagtgaaagttgttccaactttgccactcttaattacgccgccatcaatcttagtatacttaggggtaccatcagcattaacgccggtgattacaacgtatgccaccgaaacatcctgtgcatcttcagctggtgtggtagtcgttacatcagtagttgtctgcgcagtgtaatcccatccattctgatacaggtctgtatttccagccgcttcaatatgaactttatcatcagcatttggaatatcgttaattgataaataatcactatttgaattagtatcattagtagctgtatattcatagttaaacattaacgtggtcgcgttaataacgtccttaactggaactacgattgtgctaccagtaccaatagtcactggggtgttctgatcgatttgatatgaaacagccttccaagttccgttagccgtttcagaactacctgcaggagcaattgagaattggccgtttgttcgacccgtattccagtcaatttttgagttcttggtaagcacgacctgcatgtcgtatttttgtcccttgacggtcttggcaaccgttgtgccgtcgactttcacgttgttggcgttaatatcatggctggcagctaatgacccattaccagtagcaactgttgaagttgcttcagaagttgaaccactagcagcttcagaagttgttaaagttgcttcactagtaacctttggcgttgcactagaggtcggtgcagtaactgttggcgtttcctgttgaacagtcgcggttgtatcagcactagcggctcgtgactgaatcttagcagaagttgcaacagcggtttgcgttgtatcattttgactagcaacagaactggcagcacttgttgttgaagtagcactctgtgttgcagcagaaactgttgaagttgattgactagtcgtagaagttgcttggctagtcgaagatgcagaactggcatccgaagtagccgcttgactagttgctgatgaactggctccactagtaacttgttccgttttagtttcatttgctggtgttgtatcagcagatgcattgacgttggcaaatactaggccggcagctaaagctaacgtagttgcaccagcgtagacccagcgtttaccgtctttatacatctttacccgataaattgaatcaccggtcactttttgattatcttttgacatatggattcctccccaagcactcacgatttttttggcctcatgtaaaatgatgggtgacaaatcgcttgccagcccatcatcttagtcacgcgtctatcgtattgtgcttattacaccataaatggttttgttggcatttcagttttaaataacgtattagcccttaatggctttgattacgttcaagataaaactgtgtaagccaccaaagatgtcatttgaaacacttgatgaatacgatgatgtgtgtgttcctggtaaaatatgaaaatcattgaaaaagctcatgatctattccccttttaattggttaattaattagcctttaatagctgcaattacgttcagtacgaattgataaaaagtacccaatggttggttgcttacataactcgtatgcgttgcagtatgtgtacctggtaagaaatgcaaatcagaaaagaaactcataatacatatcctcctctattatctagataatatcaagtcattaatcaattaattgattaatatatctgttcgatcgattagcccttgattgctttgatcaagtttaagatgaaactgtggaagccaccaaagatatcattcgaaacacttgatgaatatgatgatgtatgggtacctggtaatacgtgaaaatcgttaaagaaactcattgtgaaatcctcctatatgattgactgtaattatttgctgaacaaactcttgattgctggaatcaagtttaagatgaaactgtggaagccaccaaagatatcattcgaaacacttgatgaatatgatgatgtgtgggttcctggtaagaagtgcaaatcagtaaagaaactcatgaataactcctccttttaagttagttaatggttaaatccccaagcctagccaattagtgaaaagccttgagagtttggaaaacaaattaaattccgacaaacttggttaaatggttagaaatttcaactaattaatcattagattccctaacacccgtctctagcaacgcttaacctttaattgcggcgatcacgttcaacacaaactgatagaaagtaccaagtggttggttgctaacgtaactagtatgtgatgatgtgtgggttcctggtaagagatgtaaatcactgaagaaactcatattaatatcctccttagaaaatttacaaattgttcacaaattagcaactcaataatcattaatttaatctgttaaataactaatgttgattactaatgcgaacgtgaaacaaataacctcgtttacgatttaaatattaactaattcgccccaaaatcgtcaataaaattactaatatttgaataaatacagggcagtatcatattcaatcagtaaatgtgcatactatggacaacttacgcgtttcattaacggtcaaaatttgtgtccaatatcaatattatttatgtttatcaccagttaactatgccagtagaaagcgtttaaacccctgataatatcagcatttcagcgtagttgcttggtgcgacatctcccctttttttccgaattatgaaccatgccatcgggaaatttattccctaaaaaataattataaatatcgcttttttcgacttattattaaaattattaatactttttatattttttacggcggttttatttcacaccgtagccatcattatccagttaaatacatatttttgaatcaaaaaagtggctattgccaacactcagcaataaccacttactaattttaataatcaaacaatatttcactaaggccttttttaaccgtgttgatactgcagccgataaaagtcacgataacgttcatgggttgctaataaggactcatgattgccatcacccgtaatccgaccatcctccatgaagagaatccgcggatacgcttcgatctggtttaatcgatggacaatcgtaatagtcgtcaggtcagctggtaacgtcgccaagagctgggtcacccgttcttggttctgattatcaagactagccgtcgcttcgtccagaatcaatagcgacgggtggcggacgagtgcccggacgatggccaaacgttgccgctgcccaccagaaacattcaagccccgttcaccgacgtccgtatcaagaccagctgacagttcagctaaccagtccgctaagccgacttgtgtcaacaacgcactcaattgttcatcagggaccggttccgtcgagcctaacaggagattatcgcgaatcgtcccgggcatcaagtctacttcctggcttacgtagccaatctgattacgaatcgagggaaccgtataactagccattgtctgaccgttcacgtccagctcaccacgctttggcgtatagtaagcctctaagagcgagactagcgttgttttcccactaccactctcaccgatcaaggcgatccgttcaccacgatgaatcgtcaaatcaatgtccttaagcaccggtttatcactttcatagccaaaatcaacgtgatcaaagtcgactgtatcgattgttgacagcgtctcgccagacaaccgcttatcttcttccggactatctaaaatgttgtcgattcgctcagttgccccgaccgtttgttgcaaggcagtcactaagccagttacgctactcagtggtgaaatcatttgaacggcatacattaagaaagctactaaacttccaattgtcaacgcgttcgtttgtaccaagatcccaccgtaaacaatgataatgaaaattgcggccagtaacatgatgtttagcactggattaagcaccgagatcagcttgatttgacggacactaaagcctttgatccgatcaacttgatcttttccctgttgtttcagtgccttttcagcaaccattgctttcactaaccgattttgaccaatcatttgtactgctgcactatttaagttggccgtttctttttgaatcgctttggagatccgcgctaacacttgacccattggcacaatgatcacggccatcaatggaaccacaattaaaataataatcgttaagcggaagtttaataacaacattaacgtcaaggaacccacaattgagatgatcccattaatggcattcgaaaactgacttgaaatcaattcaaaaatcgtcgatgtatcgttaactacccgactagacagttcccccgtccggttatggtcaaaatacggaatcggcaagtccacgatatgttgccataacgcgctccgcaacgtcgaaacggcgtcgacccccgtataactaagtagaaaactcgacgcaacactagcaaatagctgcacgacaatcacagcgcctaaccgaagcaacagttgacccgaagtaccatggttaaaggcgtcgataaactccttcaacatcaacgtaatgccaagactacaaatcgttgcgacaaacgacaacaggattccaatcacaaagagtcccttcttcgggtgagcatgggtcatgatcaatctcaataaatcacgggtcccatacttggcatgtggttgtttagccgatgacgtgatatgcgtttccattggttgtaactcccctcattgcttgaatatcaggctgaatgacatgatcattccaccgttgccaaatcatagcctcagaaaaacggctactgttgccatatgcccgttcactcatcttcgccaactgtttagggtgttgtaagagcgttaaaatcaccttgcccaattcaactaaattattgggggtgatcaatcgcccattttcaccatccgtaatcatcgttgccggaccatacttaatgtcataggcaaccaccggaacgccatgacttaacccttctaaaatgcctaagttaaagccctcatattggctagtaaggaccatcagttgtgcttggttatagaccggtgtcaaatcgcgctcaaagcccttaaacgtgataaatgactgccaacgttgcgaactgaccaaggctcgcaaccgattttcttctttaaatccagtccatgaatcaccataaccataaatatctaaggtcacattcgactgtttttcatgaacataggcgaccgccttaatcaattgttccaaatttttctctgccgataagcgagcaacggcaatcaccttgccctcaatccgatccttaaagtcaaccggacgagctgctaattgttcgtcacttacactaccaactggaatcgctaaagttggaatcacattatgaatgtggttcgtcatatcatcacactcttcttgcgtggacatgatcaaaccagccatttgactggcgtgatctaacccgatttgagtgtacggcacaattggtgagttcacaacgtcaagtgggtccagcgtgaaattactgtgtaagaactcatacttgcgcgctgctgtggacattttaacaatcggattcatcccagcatcactacgatccacgatcatggttccgtgaccgccatactcagtatttaacgcgtctaagaaaaaggcagtcagctgatcccagtcctcaaattcgtaattatgcccgtgatagtttaacagccgttgatgagtggcaactggttgttgcttctcatttggccggaaaaacgtctctaagacaggctgttgttgtaaattacagtgttgctctaacacaatattctgcttgtcatcaaagtactgggccaccgttaagaagccccgcgtatcataatagtctcgacggctgaccgcgccctgtggattgagaatatcgacgtaatcaatattcccctgcgcatttaacatcagtgctttttgccgttgttcccgttgaatgacgtcaaattcattagcgctgacccgttccagcgtttcacccgtcacccgtggataattggccgcagttaacggttcgccttcgtaattcgtagtgccttgaaaataatcatacatattgacctggaactcatcatcatacccaatgagttgcatattatgatgtaaatcgcgtacaaagttacgggtcacgatcaacgcaggtacccggtgctttgtgaataatttttgacgctgaatcatggctaactcaatagctgatggcgtcgaatcaattttgctcgtaataaagaaatacatttgctacgcccccgcttttattcatgtgataaactctcgactggatccaaccgtgccgccatatgtgccggtgccaaagcagccaataaactgatgacaacactgactgtaatgccgcccagcattgctgccccggagattcgaacgattggatacttaattaagctatagatggccatattgcctaagaattgccaaccttctccaaacagtaaccccataacggcggctaataccccgatagttaaggcctcagcaaagaacaaatgactaatatcgcgtttgcgggcgccaagtgcgcgcaaaaccccaatttcacgagtccgttcagaaacgctgacgtacaggacaacaatgatcataattgctgagactaataacgcaataccagccaccccggtcaatacgttagtggctaaacgaatataggtattcaatgaatcaattaaatcaccgattccggtatagttatactgttgcttcttattcgttcccttgatggccttgatttggtgttcgacttgcttaacattcgccaatttatctatttgaacaatggcaaaatttggtcgataagccacattcttagcagttaacatctttttgacggtttgtggtaagaccacgacgctagtatcatcgctacccgtaattccgctgacggtcagcgtctgactgaccgttacggactgattcttgcgattaaccgttgccaatttaacggtcaacttcttattgagcgcttgttgataatttttcttacccaccatcttcttagctaacttacgaccaatcaaaacttgaccattttcaggacgtgaaccgtccttaattgtcttactcaaaactgtggggttatccgtctggagactggccgtcacggttgtttttttataactcgcttgtgtgctcgcgtaatagcccagcttagcagacttaacatgtttgatagccgctaattgtttgacgtttgcagtcgtcacttcggcattcttcgcggctgtgacttgttcttggttaaccgctgctttgtaagctgctgcactggttgcttttttacgcgcagccgtgctgactttccccgtcttctttgatacttggacagcggttggattaacttgagacgtaatctggtgattcatatacttttgaatccctgatcccaagcccagcattacaacgatactactgatcccgatcgacgatccaaagataatcagcaggtaacgaagccacattcgacgcatatgttgcatggacatccggaacatctgccgaaagccaagtgttcggtaacgcgtcggttgcttatcgaccacgtcgaaaggcgacccgatcactaattcgtcatgaatctggccgtcatccaaatgaacgatccgcgtcccgtagtcagccacttcctgcgaatgggtcacggtgatcacaagtttaccttccgcagcgattgagtataaaatatccattacttcttgggtattttcactatccaacgccccggtcggctcatctgcgataataatatcggggtcactggctagtgcacgagcgatggcgacccgttgcttttgaccaccggatagttcatttggatactggtgcgtctgctgctcaagtcccacccgtttgagtaggtcctgcgcttgctggacttgttgcgcatgggacgtcttagtcatctttaatgaaagcatgacgttatccaagacagttaggtaacttaccaagttaaagttctgaaagataaacccgattgtctcccgacgataccggtccatttgccgcacattcattgaacgcaaggattggccgtctaacaagacatctccatcataatgatgatccaagccaccaataatattcattaacgttgacttaccaccaccagactccccaagaatggaaataaactccccccgttcgaagtttagattaatgcccttcaagatgacattctcttggtgatttaaggtataggccttacgaatatcgtgtaattctaaaaagctcatatatgtacctccactattttattaactacattccccacaatgtatttcctcattaataacattgcgatttttggtgaatgatgtaaagtgttattgaatacctgtggtcatcattcataattaaaattataatcatcctaaatcctaataaaccgcctacttggtagttacaatttgtaaaatatcacccattttgctgatttttacaataaaattttttctatttcgaacttattttatgacggcaatcacgacttaaccgtcagcagagataaatccaagcaccccacacattcaaggcatgaactaaaaagcgtccattactaggcacactgactgccagtaacggacgcttcatcgtattaaattacacctaatgactccaacttcaatcagcaggattcctacttaaaaaaggaccgcttcgtgaccacgcggtaaatcgcatccgctaaaccagtcacaaatacgacaatcagccctgcaaattgcaaccatggcaattgttgcctgattactgtcacttcactccccagccaaaagactagtaacccgagaacaataatgatactttcgataatgtttaatttacgcatctcaaactcctcacgtacatcacacatcgttgcgagcaactaccatgcatgactatatttgtcctttaacacctaatctattataacccgtctgctgttaaatcacatgccaaccactcacgattaaactcgagataggtcggcagatttttcattgcgtgatgtcattcaaagttagtgcgaccagtgcggtcaaaaattacgagcatcaccatgttaaattagggtcatcttgcggacgtagcgattcatttcgccaacaacgttgtgattcataaattttagattagcgacgacgctcaataacagctacgaacacagcgtcagaaagacaagcaaaaagcccccaaaacaagcagcctatcagccagctgatagttgtttgttttaggagcttccatcttaatttctaaagtgctagcaccttagtcactaagacgtgcggttaacttcttagttaattcttcgtaaccaggcttgccaagtaaggcgaacatgttgttcttgtaagcttcaacaccaggttggttgaatgggttgatcccgttcaagtaaccagaaatggcaactgcagcttcaaagaagtacatcgtgtaacctaacgtataggcatcctgtgaaggaatgttaacgaccatgttaggaacaccgccatcaacgtgggccataataaccccttcgaaagctttggtgttaacttgagccatcgtcttgccttcaagatacttcaacccatcaaggttttcggtttccttaggaatgtcaacatcactagtagcgttgtcaactttaacgaccgtttccatcaagttacgacggccttcttggatatattgacccaatgagtgtaagtcagtcgtaaagttagctgatgatgggtagatccccttttggtctttcccttcagattcacccattaattgcttccaccattctgagaacatcgccatgtttggttcgtagttttcaagaatttcagtggtgtagcccttccggtacaagatgttccggtaagcagcgtattggtaagcttcgttcttagataaatcggcatctttgtattcattttgggcatccgcagcacccttcattaatgaatcgatgtcgccgcctgataccgcaattggtaacaaaccaactggtgtcaaaacagtgaaacgaccaccaacatcatcaggaataacaaaggtttcgtagccttcagcgtcagcttcttgcttcaacgcaccgcgcttgcggtcagttgtggcatagatccggcccttagcagcttcttcaccatacttcgcgattaaacgttccttgaagacccggaatgcaattgaaggttccgtcgtagtccctgacttcgaaatgatgttaacagagaagtcacggtcgccgattaagtgaattaagtcgttgacgtatgaagatgagattgagttcccagcaaagacaacttgtgggaatttacggtcttcacgtgaaagtgatgaccagaaagtttcgtgtaagaattcaatggctgcccgtgcaccgaggtatgaaccaccaatcccgattacaacgaggacgtctgaatcgtcttgaatcttctttgcagcggttttaatccgtgcaaattcttccttatcgtaatctgttggtaaatttaaccagccacggaaatcattaccggcgccggttccttcacgcagctccttatcagcagctgtgaccatagcttgcatttcgccaagttcgttattatggacgaacttagttaaattagagctgtcaaatgaaatgtgtgccatttactattacctctttctatacgtatttacatgtcatattatacaatagctcgcctaataatgaaaagcgcttcctcccttttttcgtaaattttcgtcatttgtgtaaaaaataaatacaattattaacaaaaaaggtgctgataacttaccgttaccgcaccttcaacagatttttttaatctgtaaatcaaataattaattttttagtaaagctttactaagccttcattaaggataacgcgactccaccaacaatgaccaggatcgagccaatcaccacgtaaaccatttctcgcttcgtcttgtgctctcctaagaggtagatactcccaaacgtcgaaataacaattcccatttgcgaaagggagtatgcgacagcttgtccgatttgggccattgccataaacatgaagagattcccaataccccagaccagaccagtgacgatattacgataagttgctttaacaacccatggcttatccttaaaggaccagatcaaagcacccagcaacatcccaacagcttgaggcattacaactgcctgtgcattgacgttaccataatggaccacaatcgtatagccagcgtatccaatcgttgataagatcaaggcacgaatcccaacaccccaattttcagaagcactacggttcggatcagtcttatcagttaaggaagttaaaacagccccggcaatcaacacaattacagaagcggagccaatccaatacatgtttccgtgccattcattgaataacagcacaccggccaacgcattagcaaccagttgcatcccagttgaaatcggcgtagtccgtgaaataccaaccgccttcattgacgtaaattgttgaccttgaccaatactccagaataacccagagacaatcccaatcaaccaaattttgcttgttaaagttggctgttctacggcccagagtgccaagccaaataccaaggctcccatggtcatcccaagggtctgttgccgagcggtaccgcccattcggccactaattaagccgatactgccccacgcaatcgcaggaatcagtgcaattagaattcccattactaataatcctcatttctatgttttctctcttgcctaacgacaaggaattattttaccagttaagtaaccgttttaccagtcacaatcagggattcagggttaaatataattatttttatattttcatgaattcgttttcttagtgatagggaccgttttcaattaatgaaaacggtccccgaaataccctttaaaatttttttctattccacttaaattatggcgcacacactacttatcgagtgtcaaaaccagaaccttcaaatagttgcttgccaagtaagccttgcgcgtcacgaagtctgctggtaaccggaacgtctcactaagtgtgaagtgccgatcactgccgacaaaggccgccgtgaccgcggctttaaacttcttcattgaaaaattattcgcagtcgttgcaatcactaattgcccatcacgccgaacaactggtaaggtcgctgtcaataagtcagttaaatcagttgcaacttggaacttctgctttttcacccgcgcaaaagtcggtgccgttacgacaacaacgtcataacttagtcggtgcttctgggcgtaatctagatagctgttcacttcgattgctcgaatttcctgcttatcagggtcaatattattgaccgccaattgatcagcggtctctttggcacccttcttacttgtttcaatggaaatcgtcttggcagcacccgcaacggcagcagcagccgtaaccccattttcctggctaaacaagttcaagaccgtcttaccttgcaactcggctccggccaaccattcccggatgggacgcatatctaatagtaacccggtcgttaaatcatcagcaaggtgtaatggatacgtcaccgcgccttcagtcactaataacggctctggtgctgcttcacccgtgacgagttgactctttaagttagcttcttcgacattaaatcgtaatttcgcatagatgcctttaaattgatgttcagtagccgcttcaaaagccgcatagatcatttcgcgttgctggtaaacaccttgtgcgtaccatgtaaagacatagtaatcttgataacgatcgattgttaacccgccgagaccgtcgccatccgcattgaagacccgttgtggtaactgtggatccatgctcgttgctcgccggaccaacgcctgtttgaataacttacgaaagtaatcggtcgttggcgtctcactttcatccaagctcaagacccagcctagttgccgacgatgcttcgcaatcagcgcgtagcccataaattgagaacttgccattaacgccacaaaagagccatcggttagtttcatactcggatccttgagatcatcttgtacgagtaaaggatagccgtccttgactttacgttgcgaatttcccgtaatttgtactctttgcatagttgttgtttctcctattcatttcaaatcttatctaaactattgataaatcgctgtttgcagccttgttaagggtaacatatttagcctcagagtgcgaggtagaacagtgtcaatcgctgaaaagtattaggcttaaggtccgcaatcgattactattaaacgtccgttcctactattaatgatgggttattgctatggcccaccgttaccccgcattagcaaaaccgggcctcgagatcattacgatccccaagcccggtccgtacggatttacccgctttaaactatcacgttaatcatcaataatcggtttatcaaaaccttcatctgggaaagtaacggtaaagcacgtcccttcgttctccacactgtcaaccttgatcgaaccaccatgttgttggactaattgatgtgaaatcgctagccctaaacctgattcaccatacttcgtattctttcgtgatgggtcagccttataataccgttcccaaatatttttgacttggtccggtgtcatcccgatcccatggtcttgaatcgcgacaaccgtcgcatgatccgtacggctacccgttacttcgatcacgttagcttgtgaaaactgaatggcattctgcatgatgttaaacaagacctgaacaaagcgatcataatcggcccatactggcagtttctcgggaaccgtcagcttgaattcatcatccgcggcggccgctttctttgtgagctgttcaactaagttatgcaaaacctcggcgccatcaaaattggtcttgttcaaagcaatctgtccggttcgaattttttcgtaatccaagttctcattgactagtcgaatcaaccgtttcgtctcattttgcatcagttcaattgaatgacccttgtcttcttctggaatagcatcgtacgctaacccttccaaaataccattgatcgtagtcaacggcgttcgcatttcgtgggccgcatcggccataaactcccgacgccgcttttcctgtcgcttaatttcttcattggaagttcgcagggagttgaccatgccattgaaatcatccgccaagtcatcaatctcatccttatgattactgtcaacttgaatgtcaaaatcaccatttgcgaccgagtgcgtcgcgtaccgcaatcgattaatacgacgaacggaataacgtgccaaaatgtaacttaacaacagagccgcaatccccgagactaacagtgcaatgaacagatttttttcgatctgctgttcattggcctgcaaggtctgttcaaacgacccaatcgagatggccccaacaaacttcttcgttgctccattcttatagaaaaggggcactaaaacgtcaatggttcgcaacgacggtgtattcacgggttgatcacgattgcgtgttctgaacgttacgtggggcgactgcgtaataatcttattccgcttcagcttcttccaatctttggctgagatcttgggatcataaatcgagccaccgggggtcccactcattgttgtccccataccacttggatagaccaactttttgttagcatcatataccgaaaagtgaatatgttgatctcgtaagatgacggtcccatcatttagaaattgttgattaaacccgacaacttgattagtcttcgtattataccgaatagcttccttttcaatactcgcggcgtactgctgcaattgttgccatgagttttgataaagcatcgttctagtcgttcgaataaatgaaaatccgaggacgacgattaccgtaataatgacggcaaagaacgctagcatttgttgataaatcagtttcattgagcgtcaactccactatcatcaaacttgtagccgaccccccaaaccgtctgaataatttgtggtccagctttttcaatcttttggcgcaattttttgatatgtgcatccacagtacgttcgtcaccataatattcatagtcccagaccagttgcaaaagttgttcgcgtgagaaaacttgccgcggcttttgagctaaggtcttcaataaatcaaattctttgggggtcaagtcttgaatttgtttgtctgctaaataggcttcccgcgtcttggtattcagtttaaaatggtccgtctgaacatcaaaggaactcaccgtgctggcaggttggtcagccggcgtggtcttagccaaatctgctcggcgatgaagggccttgatccgagcaatcagtgtaatcggtgaaaacggcttggtgacataatcatcagcgcccatctctaagccaagtacctgatcactttccgaatcacgggccgtcaacataataattggtacagttggggaagccttgcgaatatccgcactaacttgcatgccatccttgcctggcaagttcaagtcgagcgtcaccatatcccagccatcgacatcttcattgaacatttcgacagcttcattgccatcataagcaaaatgggcatcccacttttccttcttaaaaaacatggccatcatttcagagaccgatttattatcttcaatcattaataatttcatagtgcaacgtcctccaagttaattacgattgctaactttgttgattaatcatcatttattaacctatctattatcataccctacttcgcgctaggattcaggattagtataacaacaaattaataacaaagcgtgcacgatttgtgaaataactgtgtcatcccatcattgagggacacttaataatcttggcacatcagtcacacatcataccagagtcatgctcactgacataaaaagcacgattttctgccgttcataccgaccaggaaatcgtgcatcattcagttacatttcacgagttgcgagcgtgaagtcaccatttaagttcaggatgactgccggttcgccccttcacaacgtccactgtgcctaattcttaaaggagtggattggtgccggaatatgacccccacgcttaatgaacgtcgttggttgattggtgttgaccggcataactggtgcttgaccgaacaagcccccaaattcaaccgcatcaccaacacctttgccggtagctggtatgacacgcaccgccgttgttttgttgttgatcatcccaatcgcagcttcatcggcaatcatcccactgatagtcgcggcactagtatcaccaggtactgcaatcatatccagaccaactgaacacactgctgtcatcgcttcaagtttttcaatattcaaacgaccagcactgaccgcccgaatcatctcagcatcttcagaaaccggaataaaggcacccgacagtccaccgacatgttcgcaggccatcacgccacccttcttcacggcatcattcagtaaggccaacgccgccgttgttcccggcgcaccgacactttccaacccgatttcttccaggatctcagcaaccgaatcgccttcgttaggcgttggtgccagtgatagatcaacaatcccaaatgggacgtgcaaccgttctgacgcgatggacccaacaaattgccccatccgtgtcactttaaacgccgtcttcttaatttgttccgacacaatgtcgatcgactgaccgcgaacttcttctaaggctcgttttacgacaccagggccactgatcccaacgttaataactcgatcagcttcaccaacaccgtgaaaagcgcccgccatgaacggattatcgtcgaccgcattggcaaataccactaaactcatgcaattgaccggatcgtcagccgcaatctgctttataatacgacccatttcaccgaccgcgtccaagttgattccagcccgtgtcgacccgacatttaccgaactgcaaacacggctagttgcagctaacgcggcgggaatcgatgcaatcagtttgcggtccccactctgataccccttctgaaccagggcggagaaaccaccaatgagatcgacacctagcgcttgagctgcccgttccatggttactgcgtacgcgacatagtcttgatcctgactcgcagccgcaatcaatgcaatcggcgttaccgcaattcgcttattgatgataggaataccgtactcttcttgaatttgagcggccactttgaccaggtccttcgcgctagtcgtgatcttatcatagattttttgccgggcccgctcaccatcactatcaacacaatcaaagagcgaaatgcccattgtgattgtacgaatatcaagattttcctcggccaccatctgaattgtttctaaaattgaacgactttccatggccgcctcctataacttctgaattgcgtcaaaaaccgcttgccgttgaattcgaatcgttaactctgatgcctcaccgagcgattctaacgccgctttggccgccgcaaaacttaattgctggtcatcccattccgccgatagcatcatggtaaaattatgatccatcaaggtttgcgaaatatcgacaatattgatttttaaacgtgctaactcgttcgctacttttgcgacaattcccacttggtcctgtcccacaacggtaataattgctttcatctttatagcctccgttagacgcatcattattcgcgtttgattgttcatatcatagcatgagttcttctgaaacgcacccgttacttttgatgaagtaacccatgagaataataagagattcctcataaacataggttcccagacgcacctttgctataatgaaaattgcttattattttcagaaaggagtcgtaatttgacacaacaaaatcatttacggggcgtcttactcgctagtagtgcctgtattctgtggggtatctcaggggtggctgcgagtaccctcttcatcaataatccgcatctaaccgcaatgtggctaacgcaggtccgcatgatcagtgcaggcttgattttactcgtctgggggatggtggctggtaaacacccctttaaaatctggcatcaccgccatgccgcttggacagcggtgagttacggtttgctggggctgattccggttcaactttgctatttcgaagcggttcgcgttggtaatgccccgattgccacgattattcaatttcttggcccattcattatcagcatctattacttcttatttaagcacgtgacacccagtcgtatcgaactgattggtatgatcatggcctttatcgggacactattgatcgtgacacacggtcacttaaacagtctggcaatttcacccgtcatcttgttctggggcggcttatccgccatcggggtcgccacgaacaccttgattccgcgaaccattttaccaaagtatggcgcattaaccgtcactggctgggggttaatgattgcgggtctgtttctaaccttgttacaacccatgtggcgtgtccacctgacgattacctggccccaattaggcttgttaatcgtcattattctcttaggaacggtggcccccttcctgatgtttgcgcgtagtttaagcgatattctaccgacaacggccagtttgatggacgccttcgagcccttagccgcgacggttttctcgattacttttctaaacgttcaactcactagcttcgattttatcggcggcttactgattatcttggcagtcatggcactttcactgaacacacataaaatgttgcactttttgcggcgccgccgagcacactcttcatcttaaactgctgtaatgattgtcatgaccagtagacagattagttggcagaacagttgagctgtgctaaactaggattgttgaatttggggatgttctggattcgacaggtatagtttgagttcggattgcgcttcgtaggttgcgtctacgtaaaaacgctcagtttaaattataactgcaaaaaataataacaattcttacgctttagctgcctaataagcgcttaacgtagatcctcccaggatcgtccatgttctggatctgggtcctaaatttagtggacttacgctcaaagcttccacctggagttgcgagaagagactaatcaggttagtcattgctgggtgccctgtcatacagcgtttgcaatgatgaaatttaaatagtatgaatatgagcgtagatatccgaggggcaatatgcttggacgcgagttcgactctcgccatctccatccttgaagtccaataaggctcaatgagcctcaaaatgcttgctaaatcaacgtttttaattctatgtgattgaatacggcacaataaaccacaaataaaccgtagtcaaaaacgtagtcaaaaaatcaattggcgggcaatacataaagtcatcttaacggatggcttttttgttgcaccattatttacaaccgtaactccgnnnnnnnnnnttttccattgtgattgatatagaaatctatgtcgtgcttgttaaatagcactgatccattaatgacgtgacctgctaagccgttcttcgtccaacctgcaaacgttccctctgatacatccgaatacgccgccgcattcttcttgcgtaaccactgctgactagcacccacatcacgcttagcctgactgattgaatccgtagttagctggtatacgaagtcgcgtagtgcctgcgcctgttcatcacttaataacaccttaatcggttctgtaattatcctcaccgcctttcaatgacttgtagcacccgcataaaaggtgtgaatcgcattcccagctaattcatccgattatcgggcaagttaaccgaagcacctttcaatccttatcaataagattccattgtcagcggcactaatttcatctatttgacggatgctttagctggcaattgcaactcaatacggtaaatcacgccttgaatctgcaaagcttgcttgatttgctggtagtccagtttcatttcaagtagcgttctgatctgctgtttaacccgcttgactgcatccgcctcactagcgcttaaatagtgggtaatagcttccgtcttaggaatattacgagctttacgcaactcattcacgttaactcctaacgcctgtttgtataccagcttattaatattgatatacaaatggccgtgttcacccaatgccggactttcactaatagcagcgtgcaagctctttgagaactctttacccagctcaaacttggcttgtcgtagaatcaactcacgtttcattaccgaaaattgcttaatcagggcttttttgaatagtctgactggcttggtgtttcctaaataagtaattaatagcatggcttgatcttcatttaagtgccagaccttacgaggtcgcccgccaatactcccactactgggtttaagcatttgaaatgccaataccccaaactcttctaggtctgcatgatactgattaatcaactggttaacggcatgatgtgtaatttccgcatagtccgcaatcacatccccagtcgtatatatttccgcgtccaatcgctgtgatgtcagtgttactaaatcactcatagctcacattcctttacttagtgactgtttgagctctgcaatcgccttttcaacacgggctttacgctcggcatcaagtggcattcgtaaccatttcgaaaacgttgtatcagcaatacctactttaaaagcaacttgccagtattttaaatggttctcttgaatcaataatctgatttctgagttcataggttgaagctcctttcacatagttgtaaatcaaatattcactttttatggtttttaagaatatatcatttacaaaaacaatattacactcgaataaccagttgtcaagaacaagaacaacatgtatcattaaattgcatatatggtttgcacacaaaaggaggataaaccatgatcagtattaatctaaaacaatatgtaaataaagaaaaaataagtatcaataagctttcaaaggtaacagggataacacgcccaacactgacaaatatgtataatggtaaagctacagggatacagtttgatactcttgaagttctatgctcatacttttctattcagttatccgatctacttacacaactaattagtaaaaacgacataggaattacatttgttgcggatactcccaataagtcaaaaagtatttttagtttcagctacactcggcactttaagacagaaacgatcacgaaaaaggcattattttcatgttcctttagcgatacaagaaatttagataacaaagattatctaacaaattttgcattctctcaaaaaaacacacaacttcctgattataattttgctatagatttattttcttctgatgaaatcaacgaattgcaaaaaagacagattattcctactactagctcagaccaatttttcagctacaatgaaactcttcagctctttagaagttttagtagtaacactcaggcatatatatctggagaaataatagccgcttttttcgcgcactttaaagtccaattaaacgcaaaaagacattatctaatcaacgtacaatggttgatgggattgttaacaggagaagaatcagcatttaatttcactgttaataacgataaaatgctagctagccagctccctaagcacgctggtattgaattgattggtctttagaataacttccctacatacttgcccgccagctggtatgaaaggaataatcaatatggcaactattaagcagtataaaaagaagaacggtactaaagcatgggagtttagtgtttatttaggaattgatccattaacggggaaagatattcgtactactcgtcgtggtttcgttaacaagaaattagcgcaattagagttatcccgtttacagcttgaatttcaagaacatggcctccgtaaaattgttatcagcacgtataacgatgtctaccagctatgggtagtagagtacaagaacacagttaaagaaagcacctacgttaaaacagttggttattttaagcatcacattttaccggcattcggtaacttgcagattaaacgtattaccgtggcttactgccaaaaggtcattgatggctggttcaaacaatttaaaaaatatcaaactattatgaactatgcggcacttgtatttaagtatgcagtcaagcacagcattattgagcgtaacccgattgacttaatcacctacccacggcgtaaagcagtcattggcgccgacaagtgggaaaacttttacgacaaaaaggaactacgccaatttttgagtgctttagataacgaagacgctcatcaaggaaactacaaagcggatgccttatttcgcatgctggcgtttactggtatgcgcaaaggcgaggcattagcgttaacgtggcatgacgtagattttaagcaacgcactatcaatatcaataaagggctgacgcgtggtgaaaacgctcggttatatgtacagacgcctaaaacaaaaaactctactcgtatcatcgatattgacgacaatacaattagagttttaaagcaatggcagatacgccagcgccaagaattatttatgtgtggttacaatgtgaacgagcatccgcaatcacagcttctctttagcaacacaaaaaatgagtatttgacgccctcacggcttagaacatggctagtacgcctgattaataagtatcacctaaaatatatcacggtgcacggatttcgtcacacacacgcttcattactgtttgaggccggtgcttctttgaaacaagtacaagaacgtttaggtcactctgatattaaaacaaccatgaacgtttacgctcatgtctcacaacatgctaaaaaagatactgttgaaaaatttatgaagtaccttgaattatgatcgttgtttcaactgaaaatagccaaataaaaactaaaccgtagtcaaaatcgtagtcaaaaagtaattacaccacatataaagggacacaaacactggtatgcaagcatttatgaacatagggggttcgatactcgccatctccattactgagtttcaaagtgatgtaataagctccagaacacttgttatatcaatattcattaaagctatcctaacgggatagctttttttgtcctattttgattagcgtgctacttcagtaaaaagcccttttccaaattggaaagggctttttttaccgataatacaaccatggttaacctgatcaaccaaaatctgtccaataattataaacgccacagccaacggtgttaaagtggattgcaaccagtctgttaaaataataagcgctcacggcactaatccagctgcgttagcatgcggccatttagaccgtaccgacccgctggcggttaaacccaacctgtactaagatccgatacaataacggcacaatgatgacacatgccaccgcattaatggtcgctgctaataaactcgtgaaggacccaatcatggcgaccttgagcgttgtccccaccattaaggcttcaatcacgcctgtacaccacgaagtgacaatttttgtgagccctgcgactaacgatacccagtaaagccggccaatacgatcttcacgatagccgattgacttgaaactcaggttgaccatcgcggccagaataattgcttcaataattgttaaccacgaagttgcggcatacccattcagaatatcaaacaagccaagccccactgcaccagccgtagcaccatagcaaaaaccaagcaacatcactgcgagcactgtcaaaatattaccaaaatgaataaatggccgcccaacaatcgcgggcaacggaattcgtaatacactgataccaataaaaataatggcggcaaataaccctgccaagacgagcttttttaattgttcagaccttcccattcaattccctccaattttgcacatctatttatcattatattctaatataagtgtgaatcaattgatagtcctagtctatttttttcgtgacggtaactgaataatagtcgctcgtgcgggcgtctcaacacttacttcatacgcaactgctaacaaatcataagcagctcggggcattttgtattgatgacacactaaataataacctagatcaacagcgatttggtgcgcgatagcaatactgtcaccactacgattaagccggcgacgagcccgcgcaactaacctggtcaacacaacatcgcttcgaatctcaattgccatgctggcaagtgctagttgggcacttaatcgttcattcggttgggtcgtacgtgcttttgcctttgccatttttttcaactcctcagtgtaatcataggagtttcactttggcttcgcaacgaatgacaccctcaaagccgcgtcatcactgagctcgtttaactttcacaaaaaatattattgaatcatttcaattcaaattcagcaacagcgcccacatcactagtccattccatataagtaaatttaacttacgatttaatttatatctgccaccgatacttaatcatccgtctcttgattcggtaacccgaatagcaataccccaacaccgagtaagagtacggccacgaacaccataaaaattgccggaatgccaaatccaattgccatcagcgcaccaactaaaaatgggccgatggttgcgccaatgcgaccaattgactgggcaacgcccataccaattccccgtaccgcgggcgcaaattgccccggtgtgaaagcaatcataattccccaagcccctagcgtaaagaacgacaaccatgcaccactaatcagaatcatcgttggattattggccgtcccaaaagctgcggcactgacgaccgtcccaatcagataagttgccaataccgccttacgcttgacgacgccgatcaaccacgcagctagataatagccgggaagttgcgccaagctcatcaacatcgtatagccaaacccatgtactaatgaaaatccgcgcaacaccaaaacgcttggaagccataaaaacataccgtaataggcaaacataatcacaaaccatagaatgctgaggcaaatcgtagctcgtcgatatttagcggaccacacttgccgcaatgcctgtctaaaatcaactttttgtggccgattagcctcctgttctgcaggtaagtgtcggcgtaacagcaacgcatacaaccccattaaggcggtgattaagaccgtcatccgccaaccaatgtgtggcatcactaaaaaggccaataacgatgctgcaatccaaccaaacgcccaaaaactatctaccaggactagcatgcgtgagcgctgtgttcccgtataatgatcagcaatcattgtcgcagcaaccggtagttcaccccccagaccaatgccagtcaacaaccgaacgactaagaaccactcgacgttcggggtaatcgtcaataacaaattaccaagcgaaaagagcagtagcgtcccaatgaggaccggcttacgccccaatttatccgctaaatagccgcataccagggccccaatcatcatgccaagcgtggtgatcgcactgactgctcccaactgtcctgcagttagctgccaactttctttaataaccggcatcacaaatgatagcagggccacgtctaacgcatcaaaaagccaggccgtcccgatgacccataatagcttagcactatttcttttactttcgaccattccaatactctcccaaatttcctaattagccttccgctaatttaggtattttttacctttatggtgctataaacgtagcataccgacttggacgtgtcaaatgaactactttagccggtataccttagcggggcgtccagaagagccaggtcgggctgtccccacctctgtaaataaatgaacgtgggttttacgaaagtttgaattgtcgatggttgccactggctgccgccacaaaatcgcatacagctggcgcgcctgtttgagtgtgaactgctcacctaacactaataagatcgtaggagcatagtccaggcgattgcgcacacgttgtagggcgtttcttaagatcaggccatgatcggcggttaacaactgcttggcgattcgttgataaaactcccgctccgtctgcgaatcgggaacaccagcaaatgccaaaccatcagcgaccagatcatcacgatccacccgcggcgtaatggcaaaccacttgacatcgcgcgcaccataccccggaactagttccggcttgactggcaaataaaccatatacgtcaacgccagtgagcgttcacccggcacgcgatcgaccgcggtaaacgtccctaactgttctgtatggaattgggcaagctggacacccaacttctcacgaactaatcgcaatgcggcttcatccgcactctcatccgttctcaaatacgtcgtcggtaatccccaggtattctcaaaaggagcgtgatcacgctgaataagcaggaccagcagttgcttggtcactgcatcgaaactccagattacgttcgtaatactgattaatggccgataactgacttcatgcgccattcaaatcgtcctcctacaaaaacggccactggcaaatgccgtggccgttgtttattttttaattcattgcttgtagcgcttgaaccgtccacccgttaatggctgacttttcaataattgctttttttatttcccagacatccgctttgatatagcgatgtcgggcggtcattaagggaatatcagtgtagacctcttgaccgcgattaatggtaacgcgcattgaattacatcctttcctaatgctcaggaaatctgtaaataattctaatactcaatactggggcaagtacatgatactaaaaattaatttatccaaaatctgaggtaaatttaatccggcagcgtgaagtccaccgaactaacaattaactttatcatatttttgaagttatcgctaacagaatgctctttctttgacttaatttaaatttagccctaataatgaagacgtttgcattgtgtaaaaacagattccgatttacactaaaggtaattttataagggaggtttttacatgcgcaattataaatatgccgtatatggcggtatctcagttgtttatttaattaccctatatgcgttgtaccaccttattcgaacggcttatattctattctttctctagcccagaccaacccgctgacttcaggataacgatcatcaaacaagctcatctgacctgactaaggccggatgagcttgtttgattttgattctaattgcgtaacgtgactgactcacaatcccaaaccaactactgattagcagagccccagtcatatcatcgatgccataaaaagcggtcaactgccagtgctaccttagcattttcatgtaactggctgtgctgcgcatgggccccataaaagtctttttcggtgtaatcgacatcccgcccacgcaataaatacttgatggaacgggccgacacgttggtgaccaagctgtccgaatgactaccatcgttcaaggttcccacgatattcaatagttgcacatttttaggaaaattgttccgcttggctgccaataattcataggctgcatgcaaatatttcggttgcccagaagtcagaaacgagttctgattagcaacatcatcttccccgaccaccccatcaaacgggccagcgatcgttactaacttattgatcttcggaaaagtcgtcgtttgttgcgtcatcagcatattaacgctagcgacacagcccgcagaatgggcgacgatattataatgtttaaacgcgtgctgttgttgaaccgtggtaatcaccttagccagccaagcactctgttggtcatactgggccagattgttcttgaacacgacttgaattatcgggttacgcacccgaccacgccatttacccgtcaacgtcacttgaccactggtactgaccgttgccaccaaaactttgtgagcatgagcagtcttttcagcatgcgcaatcagggtattcgttgacttcgcactcccctgaaacccgtggacgtaaaatgtgggggtctgttgattcacatacggcgatatttttttagtacttgccgcctgttgcgttgcttgtttcttagtggtttgagaaccacaaccggttaagccaacgactaataagactgccaacagccaccatttaatttgtttcactttatccgccccattaatattttgaaatattctactctaattaaatctaagtcaattgaactcacattaccaatttcgtttgacagcgaccaactcatcttgtaaataagtgcttgctaaccgcaagtatgtcacgtgtttgccaggcgtgggtgcatgtaatagccagccatcaccggcatatagggcaacgtggtgtaccgcaccgttcccatgattatgagcaaagaaacacagatccccaagctgggcatttgctatgtcgaccgccactccttgcttgatctgatcctgagcatcgcgcggtaagcgaatacctagactgcgatgcaaggtatagacgaatccagaacaatcgaaaccataagcactgatgccaccccataggtagcgtaaatccaagaattcttcaccgagtcgaacgagtgtcgctcccggtgtcaagcgcgcggttctaaatgcaaactgcgtcgcacgttttgcaatttttccctttccgagtggggtctggaccgtataataacgatgatctttgctactaataacgggtagttccgttccaaggctaagatttaagaacgtacggccatctaagcatagtaacggcgtaaaaccacgccgtatcgtaatcatcggcccagtttgaaccggcaatgggacggtcgacaattgcgccgcccatacccatcctggatacccctgtggatgccgggagtcggcctgattaacaacgtaaccataggcccagccattgacaaactgttcgactaaaaagacgtcgttaaataacgcctgcgtcacgatgcgattgtcgcgttccaaagccacagtatcttcatctgataactgcgccaaccatggttgtaagccgacatttgctagtgccggagtatcgatggacgtattgttcggctgccgccacacgttcgcaacggccgcaataatccgtgttgattgcattctagtcacctcattttttcagtttaccatatctccggaaccacgtctggcttcctgatcaaaccttgaagtgattttaactttaatcgatcgccccccaccgccgtggcacctcggcacgttaagaagctatcctttcagtagaaactttacactaaatattaaaaatcactgtgaaagtatgctatgatactaataattacttaggaggcgttttaacgatggataaaaccgatttgaagattttgaacgccttgcaggccgacgcgcgaatctccttaaaagctctcgccgatcaatgcttcatttcttcgcccgcaatttccgctcgcatcactcgtctgaaaaagagtggcataattcgtgactatcaagcaaatcttaactttgaaaagctcaattaccacataaaagcctatattcaactccaacttgaaccaacgcaaaaggagcgcttttacccatttgttgccggcattcctaatattctggaatgtgactgtgtcacgggtgaatactctcaaattttgaaagtgattttcgaatcaacgcaggcattagacgagtttgtcaaccaattacaaacatttggaaaaacgagtacccagatcgtcttttcaacaagtgtccctaaccgtggcctcacgttgccagatgatcacgacatgtctaaaattagtcattaatccgcatgcacagggaaactgtagcttaataggcgcaccgagaaaccatgttagtttctcggtgcgcctatttaatgaattccaattgcaatgtcagagatcggtagcccgcttcaaatcaaacccaactatcagttatgggcacctcaggaccaattcaataacctaaaaatcgcttgtggtgtcgtcacttgataatgacgcttgagaacttctaagccaatattacagcctaccaatagactcccacctaaagccacgcccacccataattgtggtcccaaccaatgaatggcaactaaactacacaaaaataacaccgcaccaacaatcattcctagcgtgtaactcacaaaccatcgtctcattgggcacctccacgacacaaactaattacgcgaatcggttcatcacataaattgcaccaagtccaattccccataaaactaacagcggtagtaaaacgagcatgccgaactggtaccaacctaataccatcataaataaaatctcaacactatggccgaacactaataattgaaagtattcacgaaaataccactgcacgccgataccaatcaagaaactaatcaagatcacaccatagaacgtttcatgcagcattttacaaactcctttttattgcgtttgctatctaaccttacatggtaagtatgccgtattgaggcctaaatcatcatcatatttatgtaaagactaggttatttttcagtaaagactgtttgatgatttttaaattattgcaaactgctgttaacagttacctgcgtaacgtgttatgattaaaggacaaattaattaaacgcaacaattatgggggcgcactgtgttacatctacttacgctatcgagcttaggccgagatctttttaatatcaaaatgctaattgtcattctcattacaattggcctgatcaccctaatgaccattctgacctacctcctagagcaacaggtccatcgtcgtcaaaatcgacattggactattggggcccatggtgccgaggctttaagtgtcctcattagtatgatcctattacgacaaatattcattacgctgaattcaggtagcattatcagttggacctacgcaacggttcaattaacgattcttctgttcagccttaacaccatgcgcaacctggccgttgaaattattaacctgttaatgccattgtccatttatggtcaggccatctggttgggccacagcacgcagtacctgccagtttttctggccatggccattatcttgattagtacaatcgtctatattactcataactatcaagaattacacgctactcaatggaagtatctcctgttccaaatactatatagtggcacttggtggggcgttatttggtcagttcatccgttcaaattgagccatacactcgtcatcattctagcctttgtcctttacatgtggttgattcgtttagcagtcaatcgcgtccaaaagtttttcaatgaagtgctcacctttgatcaacaagtcaattacgatgaattaaccggtattcgtaaccgcgccagctttgacacgcatgcgcgtgaagtgtttgccgcgtatcagcaccatcaaatggggcccgtcactatggtcatgttcgatattgaccactttaaagcctttaacgatcagtacggccatctggctggcgacgccgtactccgacacgtggcgcattttgttgaacttgaacttaatcagcgtagcactcacggtcagatcttccgctatggcggtgaagaattcgtcatcatttttcgtggcatctcagcgcttgaagctggtcaaataatgcgtacgattcagcgtaaactgaaaacagtaccaatcaaatttaacgctcaaacgttgaacgtgaccgtttcaattggcatttcagaattgcaaccaaccgaccagactttcactgattggttcgtccgcgttgacgactacctctatcagtccaagcaggccggtcgcgaccagaccacggttgaaagtcaattactaacggattaataattgttcccaaaaggccgttaatttgtaaattcgttcccgatttacaaattaacggcctttttgggtttagcgattaccgatggggacaatggcgcgctgacggtccaataattactgaatcgccagcagtccattttcaaattaactagtcagctaaaaataattttctcctaatcaggacatccaaaaacagtccatgcttgaatgtctgtccacagacaagcccaagcatggactgctattaaaaaggataagaattagccttgtcgttctttcaaactgagtttctcgacgttcaattccttgtcaacccagccattcacaaaactgctctcatgactaaccaagattagattaccttggaaagcctgtaatgcacgcttgaggccttctttagtttcatcgtccaaatggttcgttggttcgtccataattaagaagttacttggaaccaattcaagcaaggctaatttaaccttagtctgttcgcccccactgagtaagtgcattggcttcatcgcattcgccgcattaatcccacacttagccaacttagtccgaattgtcttcggtaacatcgtagggtattcattttgaatcgtctgtaacggtgtcaactgtgggttatcccattccaaatcttgattgaaataattgattttagcagatggcgaaaaatctgacttaccacttaacgctggaattacacctaaaattgacttgatcaaagttgatttaccaaccccattaaagcccttaaacgctaatttttcaccgttggtcatcgtaaaagtcacgggttccaacaacggctttccgtacccaacagacagcttcgtcacactcaatgcattttgagaacccgtatcaaggtatggaaaggcaaacttagcgtgttcattttcactcggtggatcaacccgatccaaatgcgatagcatcttttcccgtgacttcgccatcgttgactttgaaccggccttgttcttgcgaatgaacttttcggctttttcaatcacaacttgttgcttttcaaacgccttcagttgggcttccttacgtgcttctttttgccgcatagccgctttaaaatcgccccggtacttaataattttaccgaatgccacgtcacaaatacagtttgtgacctgttgcaagaaatcatagtcatgagagatcaccataacggccccttcaaagccgttcaaataatcttccaaccaactgatatgcgccgtatcgaggtagttcgtcggttcatcaagaataatcacatccgggttttccagcaatagtttagccaagatgatcttcgaccgttgaccaccagacatctcactgatgacgtgatcccgaccgatttcatctaatcctagtccggtaattacccgttccatttctgtctcaatatcataaaaattattggcttccaaggtctcctgaatcctacctgcacgttccaataactggtcatccatcttttcagcataatccgcataaagttgttgcatctgcgcatctaaatcatacaagcgttgaaaagccgttttcaaaaaggcgtatagcgtcatgccggctggaatatcggcgtattgatccagatagccagttcgaacgttgcgctgccacttgatctgaccagataatggtaagatctggccagttaaaatcttaattagggtactcttacccgccccattttgaccaacgatacccatatgatccgctcgttccagcgtaaaattcgcatcgtcatataatttacggtccgcaaagctttgcgataaatccgttacttctagtaaagccatgttgttttcaacctacactttcattttgacccgtattaaaacgggccccgtcatatcacgaggcccgttgcgatagccctgatactaagctagcaccaagtctttatctagttcatattgcatatggaagtacatccgatcaccgataggcttaattcctaccgattcgtaatgataacggtcatagagcttcttagctcctaaattagccatgtcaacgttcaaaccaatccgcttttgaccagcttgtcgcgcgtatcttggcagggcggcgagtaacttcccgccaatcccatgaccctgataattcgggtcgaccgcaatcgaatccaggtaccattcgtgctcataactttcagcttcagcttcaaatgctgaaccaaacgcatcattattcgcagtaactcgtgctaacacgtcgtccaccgcgtcctcatttttgtcaggataaccaaacgctaccccgaccacttgaccatcggcctcggccactaccgtcgttgccttaccagacaaataatcaggtgtccggtaagcggcagtaatggcctgctctaagtcaggttcaggaatgtcgtctagttcctcaagttgcatttcatcaaaaatcatattaattagcggtgctatctggcccgcgtcgtcttgatcggctggtcgaattgttatcacgaatagccctccttcttatagtaacacctacattactatgaaaagcaagcattgtcaaaagtcgcgtccggtgtgaacggttacagttgttattttttgagttgcttcccaaatactgtcatatccgtcccattatcaatcgtggtatactgaataacaccgtcttatactcattattattggcatgaatcatgattaaaacgtaccagttagattgctgttcgtcagccgttgcgcgtcctatgccgacctccggggctgggtgccaattgcnnnnnnnnnnaggggccacgggttgaagccgagtattgcctggccaacagattaatgtggttttggcatttgtccgtcggcgtagcaagcacaggctttagtggcaccgaacacgttttgggaaccccctcgaatggcagattaacggccacttaacttggtaaaatttgtcgctgactattttgataccggaacctcaaacgaaacgtcagggttccattaaccactttgtcgagacgttcgattattactatgccgcttgaggaatagtgatctcccacaatatcactttcagactgacagttaattaacaaaattaccgtttatgaggaacaatgataagtccatcaaaggttgggtacatctccgtcagccattcgaatactgtcccgactggaaggcgtttcggtcaatgctcagcggtgaaattccacttagcaagcgtcctttgcttggttagtggaagaccagtatttaagacgtgggttgcggcttaaatctgtgtccaccgcgttccagcaattgacggaaatgcctggaagtcggcgtaggacgaaccagcaaagcatgtttacgctaactcgcacgttttccagcgggcctaaagctggctgcttttgaacttacacaactggtacattttaatcatggttcatgccaaatctgatgagtacgacacgtttaataatgaattatttttgaagggatttgagcttgtgaatattcgcgatatcgatcatttgaccctaaccgttactgacattgcacggtcattacggttttaccatgaagtatttgaccttcccattgtgaccttcgatggtgaccgccaagctgtcttagtgggtaaacaaaaaattaactttcagaccactgaccagccacaccaacccattgcggctaagccgacacccggcagtgcagatctttgcttgattgcgaaagataatattgatgatatccagcatcacttaaagagttatttcgtggatgtgattgccgggccggttgaaagaactggtgcccacggaaagttgacgtcactgtatgttcgtgatcctgataacaacttgattgaaattagtaactatcattaaaaaacaccacaaagactaatcatcgaagacgcccagggcaactgttcagtaacttgcgaacaactgccctgggcgttttttgatcgttatctggatattttagtcaatcgttgatcaatctgcactgctagctgtgtcattccagcggctgtcagtcccgtttcttctggataaatcagaactcgcgcactagcttgtaagtccaacacggctgccactggtcgactgacgaccagcaattggtggtcggtcaccggtaagtcgtccgcggttgcaaccctgaccttaagcatcgattgagttagcgcctgcattagtcgcttgactagtcgtgcatcaagtgccgcgtcaatcaccatgcttcctgaaactgaattctgtaaaatccccgttggcgttgagttcaatactaatacttcgtcaatcatgttaccgcccccctataatgccaatagtatatcgtgggagtcagtgggaagcaatcaaacgcactgtccccgcatcaagttgttcatttgctgtcatccgttgcctcgataaccaatgcgacaaaaaaagttccgcctaaatcgaaaagatttagacgaaactttttcaataaacccaacgtcgacagcgcgtaacttattcagctgcaccaatcaaatcaccgctagtcacatgaccagttggattaagggttagtttgttaacgtgatccatattggtgataacgaccatcatggttgtcgctttaccggttgacttgatagcagccaagtcaaccgtcgctaccgcagtaccggccgcaatttcgtcacccgttgccacgtgtaacttgaacggcgtaccattcatttccacggtattgatccccatgtgtaataagacttctaaaccactcgtcgtcttcaacccgatagcgtgtttggtcggaaagacacttgtcactgtcccactaaccggagcaacgacttcaccatcttcgggttcaacagcgtaaccatcacctaagagtttaccagcaaacgtctcatccgcaaccgcactaatcggcattaattgtcccgttgctggtgcccgcaaaatcgttgtcaccggcgcttccgttacagtagcagtttgcggttcaagcggggcctttgattcagcatcagatgccggggtcgtcgccacctgaccagaaaataatttttgtaaagcctccgcgacgaactggacttccgtaccgatcacaatgtggatgttatgaacatccagtacgttcaaaccaggcacgccagcagccattacggccggctgatcgactttttccgtatccttaagttgtaaccgcagccgcgtcgtacaattgttgatcacactaatattgtcatgaccaccaatagccgcataaatttgctttgcttggcgcatatacttatcatccgttgctgcaacggccaccgctggactagcaggtgcacccaccccatcgacatctgcagacacaacttcacgaccaggcgtcttcaaattaaaccgtttgattgcaaagtcaaaaccaaagtaataaatgacggccatcaccagcccttgaaccagtaacatatagggttggttggctaacggcatccgaaaactcaataaataatcgactaacccgccactaaacgaaaagctggcggtccagtgcattaacgcggcgaatcctaatgatagccccataaaaacggcatgtaataagtagagcggccatgccacgaacatgaatgaaaattcaagcggttcggtcacccccgtaaagaacgacgcaaacgcacccgctaacatcaatgaacccacttctttttttcggtccggtcgtgcattacgataaattgcatacgcaccagctggcaagccaaacatcataattgggaagaatccagcttcatacatccctgtgattcctttaacaccatggctggcccagaaattgccaatatcattgatacctgcaacgttataccagaatacggaatttaaggcgtggtgcaaaccagtcgggatcaataaacgattgaaaaagccatatagaccagcccccacgaaacctaattttgaaatccccgttgcaaagaggacgatggcatcgtagacaaacggccaaacaaggtacaataccgccgtcacaatcagcatcacaaaagcagccataattggcactaggcgtttaccactaaagaatgagagcgccattggtaattttacttcgtggaaccgattatagagcgcagccgcaatcagtccagcactgattccaatcagcacattgttatctaacgcgctaaatgctggattgatctgactcactttaacattcagcatcgtcgctaatgtcgctggttttaacaccatcaccggaacttcaaacgcgatcaaaccagcaatagctgccgcgccgtccttattgactgacatcccgatagctaagccgactgcaaacagcaaggctaagttattcaggacaacgttaccaccctgaatcaagtaatttgcaaacaaccactgttttggcaagtaattcccaatcccaaccaaaatcgctgctgcgggcaacgttgcaatcggtagcatcaatgactgaccgattttctgaaaatatgtcttcataccaatttctcctcgttctctttttaagcacgttataaatcctatcacaacatgttttcattgcaagtttacaaggtcatctaagtgtatagaccaatgtcaaagaaaccgatttcaaccttactaaattaagtttttccgcccacaaaaaaagttctgaaaatactcagaactttttcattaataatcttatttttcagcaacggggatttccgggtgccggtattgccgcatcatttctgctaaatggacttcgtgagtcacaaactcatgcacgcgacaaacgtagtcatgttcccgcccaatcttagcaatatagccattaatataatcaacttcggttggccgtccctttgagaagtcttgatacattgatggataatggtacttataggctcgactgaccgtttcaaccgagtcgatttcttcttgccgcgtctcaatgagtttgatgcctgccctttcgcaagcatcataggcttcgttgaacatttgagtcgccatatccttgacgcccggatattcgatgaattggcccatctgaatctcgaacatcgtgcacaaactattggtgaccgcgttaaacacaactttggacatgcacatgcccataaaattatcagaccaaatcggatttaaatcagccgccttaaaatcggccatcacttgcttggtagtcgtatcaatatgacctgcatacttactcatatgcatcgcctcactacccttaggccccataaaatcaaccgtacccggaccattcaagaccgttgcaatcatcgccgtaccaccaataatgtgattttctgggaaatattgtgcaatcttttcaaagtgccccatcccgttcattgcggcgaaaacgtactggtcctcatgaaataacgacgcatcgcgcttgagctcatcggctaactgcatttgcttcttaaaaacaatccaaacatctggatgaccctgatattcttcaggataataaatattgattggaacgacatggtgattttgatgatcacgcgccacatcaacgccgccctgctcacggacctttgcgacgtttggttcccacgtgtcgataaaatcaacgtcaacaccggcgttttcttgtaacattacaccataccgatatcccattgcgcctgcgccaataatgccatatttcataagtaaaaccatcctttcgtcttgcccactatgtgtatatgttccccgctcgcttcagtgcttttccaataaacgggcccgtacttacgatctactatgtgctgtcacgtgatgtcgaacaactatgtgtttacgatgattaaccgcgatgcgcgacctaaataatgactactatgtgttaactaaaaaataatgctatgtgtcacttgacgaaaaagcgccctttgaataatcgatcaaattatccaaagggcgcttacgcgcggtaccaccttattgctaaccgaactcacatccggctactcatcgcgttcacaacaactaaacgcgtgcacaataatgggtgctaccagtgaatctcgtaaaattcacgccaatcctttaacttttactcacttgtcatcacaccttcacagcaacggcgctttctgagcatcacaagtcagttactccttaaagcattatagcttttcatcaagttttaatgttataaccataatatcattttagtaaaatgtcaaccttcgatgcaaaacttttttaaaacccagctgtctgtatacgacagtatcatcagcaaaccgcacacgggcaaccccaacggcctattgtttttgctcctgattgagggtcgtcaacaatggcttccaatctaatgaccagatcattccgagcgcatggtctccagtcaagacgcctaaaactggaccgataaccccagtcttgacccggactgctggaaactgataacgtagttcgctcgcccagtcttcggcaatctgcgcgtcattagcgctgatgacgtccagccgaactggtaattgactgttcatcacaaactgactaaattcatcttgaacagcctgttgtgcatttttgagcgtccgttccttacctaaaagttgaatcttcccatgcccattgaacgtaataatcggcttattgcgcaacaccatcgttccggccagactactattgttataaatccggccatttttaactagatggcgcatcgagttaacaattaagaccgtcgtcgtagccgcccgcaagcgcgtcagttgcgcaataatttcatctaaggtgtagtccgccaatgccatggccgcagccagcttcaccatgttcgccgtccccgcgcaagcagttcgtgaatcaaacacccgcacgtcaataccgtcaactgacggcgcataggtcttcaaattattgatccagccactgataccactactcaacccaataactagaatttggtcatagcccgccgcttgcagctgatcaaaaacgacttgcatctctggcattgaaatttgagaaatcgttggaatttctttttcaacttttagtaatcggtaaaattgatccgtcgtgatatctacgttctcgtggtaaacatgattaccgaacataatcgggtcgttcaccaccgtaatttggtagtctttcaccgcctgcgcttttaaattagcagagctttcggtcaccaccgcaattttcataatttcactcctcatcgtgtcagtcaaccaactgccacgtctcgctaactcatttcaattagctcatccacttagccatgggtatcccatgggaacttagcatcaaaaaaagacactcagatacagtatactgtacctgagcgttctttttcaaattgcaacatttatgggagatgttattgaattttcggtcacttgcttccagtccgttgtaccggcaattggtatcaaagtcagtggcaagttcgcacgcagctttttgcgtttcaccgcacttaatccagtaatctgataacaatcatcggcaatcgtttttactgagaaatcagcttcattagcgtaatatttcacggcttctggtgcgaccgaaccaatgcctaagtatgtttgtggtaactggtcaaatcgagtgaccgttaacgagacacttcttttctggttacgaatcattcgataaccattgataaggtgcttggccgctactaagacgtcatttagaacactattagccgtcgccgtacttcccgcacccggtccggtatacaagctggtaccaatggcttcactttgagcagctacagcgttttggaccccattgatctgactcaggggttgatcaaccggcacggccactggcgccacacgacaatacaaaccagatccgtgtcgctgaatctgcgcgagcaatttaatctgccagccattttcagctgctaatcgacaaaccgaagcgcttaaatgcgtgattcccgtgggtgcaatctgcggcaggctcaactcttgcccaaaagcaaagcgactgaggatcatcaatttgtacgccgcatcaatgcccgcaacatcattagtcggattagcttcggcgtacccggctgcttgtgcagtagctaaagcttgttcgtacgattgcccggttgccattgcacttagcatataattagccgtcccgttgatgattccgctgaccgcctgcacattgtccgtcacgtaactatctgttaatgtccgcaagatcggaattccccccgcaacactagcctcgtaaaataaatcacagccctgttttttggctaacgcagccaattcaggtcccgccgttgcaattaagtctttattagcggtcacgacagccttaccctgattaagtgctgccacaatggcctttttagcagttccgaccgtccccatgacttcaatgactagttggatttttcggtcacaaacaacgttcgttaatgaatcggtcaagcgcgtcccaatcggtaactgaacagtccgaggcgcgttcaaatgattaacggcaactgctgctaggtgcaaccgaataccctgcgtttgttcaattttggcagccgagcgggtcaaccgttcaaccaccccactacccacagttcctaaccctaacatgcccacttcaattgtcgttgtcattgtcgcaccctccgtttcacatactttcaatcatcgaccattccgacctattaaacctgtgccaatgcttgatccaaatcagcaattaaatcatcggcattttcgacacctactgaaattcgaatcaagtcaggcgttacaccagctgctaacaattcctgttcatttaattgcgcatgcgtggtggaagcgggatggataattaatgatttagcatcagcgacgtttgctaacaatgaaaagagttgtagatgttcaattaatgccttaccagcagcctcgccaccagtcaatcccagggtgaagatcgaaccaaccccattcgggaagtacttagttgctaagtcatggtacgggctatcttccagttctggataattgatccaggcaacttttggatgtgcttttaagaaggcaacaatcttgcgtgtattggtcacgtgtcgttctactcgcaatgacaaggattctagaccttgcaacaacaagaaggaattaaagggactgatagttgcaccggtatctcgcagcgtttccgcccggaccttagtcgtaaaggctgccccacccaaatcggcaaaaacgaggccgttatattgcggatctggcgttgtgaaatctggatacttgccactcgcacgccagtcaaattggccgccttcaacaataacgccacccatggtcgtcccgtgaccaccgataaacttagttgctgaatgtacgaccacgtcggccccatgttcaagtggtcgaactaggtatggtgtcccaaaggtattatcaacaataaaaataatgccatgatcatgagcgatttttccgatggcttcaaaatcaactaagttaatgccaggattaccgatactttcaacgtacaaggccttagtatgatcgttaattgccgtctcaaaatttgccggttcgtcaggatcaacaaagtgcgttgtgatgcccaacttctttaacgtcacgctaaacaggtcataggtcccaccatacaaggtgttggccgccacaatttcatccccctgttgcgcaatgtttaaaattgccgcggttatcgcagcagaacccgttgcgagcgttaccccagccgtcccgtgctccaaggcggccactcgtttgtcgaccacgtccgtcgttgggttcgtcagtcgtgtataaatattgccggcatcagtcagggcaaagcgacccgcggcttgcttggcatccttaaagacgtatgaagtcgtttgatagattggcacggcccgtgcgcccgtttcatcaaccgtctggcccgcatggacttgtaacgtttcaaagtgataattttcaggattcgttgttgtcataattaataacctactttcgttaaattcaaagttgctaaccagttttgatacagttgattgcttgaagtttgccaactgtaatcaactgttgttaattgttcagtagcaaagtaatgttcaggtaactgaatcggcaagtgcttacgtcggtcgcgcaaatattcatcggcaagcgtgcggcgctcgtattcaggatgaccggtcacatagaccgcgtgcagcttgggggcagataagacgagcggtcccaccttcggattgtcagcgacaacctgcaatccagcgggtaagcgttccggcatcactagtgctgtatgccgtgactgtggcatttttagcaaacctcctgcattcagtccactaatcagcggcgacttaacatcagtactagtcgcactataaataccgaatatcttgtgagcaacagcgcgctttgcgattccaaactgtgcgtatagccctgcttgtgctgcccagcattcaaataaagtctggctaacgtgctgtcgtgaccaatcaatgattgttaacaattcgttccagtaatcgactgcttcaaacggtaacgtctcaactggcgcgccggtgacgatcaagccatcaaaatactgatcttgaatatcagccaacgtcacgtaatgtgccgcgacgactgcttgtggcaggctcttgaaatggtgactcgcgggatacataaacgtcacagccacatctgtgttaccggctgcaaaacgctttaggaactgccgctccgtcgttaccttagtcggcatcaagtttaaaattaaaatctgttgtgcctgatgactttcttgacacgttgcgttcgcccattctccacgggccgctaataatccattatttgctgtgactgtcatctaaccgctccctctcacctgtattgaaacaaaaaaaaagctcccatccattagtctctaatatgttagaaactaacggacgaaagctttcgcgttaccaccgttgttcgctgccatctcacgatcacaacctcgacgagtaccctgaaaaatctaggaaaccccgcaatatatcggttgccaccgcatgcgtagccactacgacccgcatcatgactccaagctcatcttcaccgcactcctgaatacttctctcaccattacgaagctctctgcaaatcagtgatgcgattactcttctcttcaacgtcttaatctgtttttaatttaaagctaatttagcaccacctttattcattgtcaactcattttattgtttttcgttatgttttacttgaatgcttattcaaaacttgctgaataactaaaatcaaaagcagccagcttaggcccgctggaaaacgtgcgagttagcgtaaacatgctttgctggttcgtcctaagccaacttacaggcatttctgccaattgccggaacgtcttccagtcgggatagtattcgaatggcggacaaagatgtactcaactgttgatgaattcgtcgttgctttttatcaacagttattttgtcaatcaactgtcagactgaaagtgatattgagatagctcactaatcctgaatcggtgtagtaagatttaatctctcaacagaatgctttaatgaacctaacgctttgtttaaagtgccagtatcaaaataggcaccgataagttgcgctaagctcggtggtcgttcatcagccattcgagcggtttcccgaaacgtgttcggtaccactaaattctgtgcttgctacgccaacagactaatgtcaaaaccgtattaatccgttactagacaatgttcggcttcaaccgtggcccctcacaggcttgagaccaggcgggttttgctcgggcttaaatcgacgtcggctgcgttccagccattggcaccccgccccggaggtcggactagaacgaacaaatgccgacgaccaagcatccgcatctcacaagattttcaccacaaattttaatatttggtgaaatttatccttgacacttttttcgactttgcctatactgaactcattcaataacgaaagcgaggaaccaagcatgtcaaagtcagttactaacttgaacagttcatggcaaagccggccgttcagattgtaatgccgtccacacggatacaatctggcaaacagtttgtatctgtgccggctcactttgatattcaaagaagtctgcatgggttttaacacagcaggcttcggttccgtaaagggcaaaccagagcttactggtttgcccttttttattggctttgaacttgcccgagcttaagaaattttttgaggtgattagattgaaacgtatgattgcattcattagtgccttgatcgtctttctgggagtggcctttgtcatgacaggcaaaaccaccgccacgaagacgaccagtacaaagaaagtgccgacggtcggcattcttcaactccagacccaccccgcactcgacgcgattcatcgtggcgtggtcgctggtctaaaggaatatggttatgtcgatggcaagacggtcaaaatcgactatcaaaatgcccagggcgatcaaagtaacttgaaaaccatgagccaaaaattcatgaacgaaaacgccgcgttaacagtcggaattgccacccccgccgcgcaggccctcgcttctgcggctaacaagcaaaaccctgttatgttagcaggtattactgatccatcgggtagcggcctaattaaaagcgaccaacatcccggtgccaatattacggggacttctggtgaatctccattgaaatcccacttagacttgttgcggaagctcgttcccagcgctaaaacaatcggaattatttacaccacttcagatcatggtggtgaatataacgccaaaaagtttgcacggatttgtaaacaagaaggtgtgaaatacaagttatatactatctctaacaccaacgatatgcagcaagtggctgaaaccatggccgccaatgtcgacgccgtttatgcgccgcaagataatggcgtcgcaagtgccatgaaaacgctagtctccgttacaaataaggctaaggtaccagtcattccagccgttgatacgatggttaaagcgggcgggctcgcaaccttatccgttgaccagtatcaacttggtaaactaactggtgaaatggcagcccaagttttaaagggcaaagcaactagcgactacccaatcaaagtcatcactaagggtaagatgaccatcaatttaagtgaagctaaaaagctcggcatcaagttcccagcaagtgtccttaaagaagccaaagcgaaaggggttatttacaaatgagtatgatcgtatcgagtatcggccaaggcctcttgtgggcaaccttaggcgtcgcattatttttgacatttcgaattcttgattttcctgatatgaccgtcgaagggacgtttccactcggtgcggccactgctgtcatggcgattagccatggaatgggccccgttaccgcttccctgttagccttcgttgcgggcgcgattaccggcctggtcaccggcctactttataccaagggtaaagtgcccattctcttagccgggattctagtgatgaccgcgtgcttatcaatcaatttgcgcattatgggcggcagttccaacgtttcattgctaggcaaacaaactattttttctaatcactttttggaatcactgcctaaatattttgacagcgtctttgttggcctagtagtgatcagtatcattaccgtgcttctgattgtcttcttgcaaactaacctcggccaagccttcattgtcactggtgacaatcgtgaaatggcacgttcaattggtattaacaccgataacatgaccatcatgggattgatggtctctaacggtatcattggcctgggcggcgcattaattgcgcaaaataacggttatgccgatgtcagcatgggaatcggaatcatcgtaattgcgctagcctcgatcatcatcggtgaagttgtctttggtgaattaacgttgaatcaacgactcgttgcggttaccctcggcagtattttgtatcagttcgtgcgcctgttagtcctccaactgggcttcaacaccaacgacatgaacctgttatccgccttaattctggcaatctgcttaatgttaccgcaattcagtaaagttctacatcttaatcacgttttaaagaagggagtggcccgttatgacgaacagtagtgccccattattatcattaaaaaatatcgtgaccaaagttaattcgggaaccccgaatgaggtcaaaattttgcggggcctgaacttagacgtctatgatggtgattttattaccgtacttggttcaaatggtgctggtaagtcgaccctcttcaacacgatcagtggcgagttgccggttgatagtggcaccatccagttacgtgaccaggacatcacccgactatccgttgaaaagcggaccgctttcctggcgcgcgttttccaagaccccaagatgggcaccgcaccccggatgaccgttgccgaaaacttactgcttgccagccaacgtggtaagcgacgtacgttaaaattacgccaattgaaaaagcacctgccccactttcaagccttaacggaaacgatggatggcaacggtctttcagctcggctcaacacggcaacagaaaatttatctggggggcagcgccaggctctgagctttttaatggctaccgagcagcgccctgatctcttgttactagatgaacacacagccgcactcgatcctaagaccagcgctcaactaatgacacaaacgaatcaacgggtcacggaggaaaagttaacgtgtctgatgatcacccaccatttagacgatgcgcttcgctatggtaatcgcctgattgtccttgatcagggccagattaagtatgatgttcgtgatgaggaaaaagcccaattgaccaaagaaaagttgctaagtttcttcgatattattgaataatcattaagtccatccctattaatactgacacccagtcatcaattttttgatgattgggtgttttttgcagctaattgtaaccgttttagttgtgaacaatttattttagtgctatattctaactagaatatttctaaactaaatggtgtcgacgggcacagctatttttcactgataatttagaataattacaaactgcccttgccgacaaacttagttcgtgttatattctatttagaacagttctaaactaaaatttggaggctttacaattatgaaagttattgtcgttggttcttctcatggtggttatgaaacggttcgcggtattttagccgctcgaccagatactgaaattcaatggtatgaaaaaggtgattttctgtcattcctctcatgtgggatgcaattatacctcgaaggtgccgttaaagacgttaactccgtcagctatgccactcctgctggcatgcaagcccaaggcgtccacgtttttgtaaatagtgaaattagtaaggtcgaccctgctagtcacagtgtgcacgtcattgaccacgccactggtgacgaacgtgatgaaacttatgacaaactagtcctaagtgtcggcgcggtaccatttgacctaccagtacccggccatgacttagccaacatctacgcaatgcgtggacgcgactgggccatcaaattaaaggccaagaccgttgaccctagcgttaagaatgtggttgtcattggctccggttatattgggattgaggcggctgaagtctttgccaaagctggcatgcacgtcacggttatcgacctattaccacgtttacttagtctttaccttgatcaagaattcacggatatcttgactaagacgatggccgatcacggcatctatgctgcagttggccaaggtattaaagcgtatgaaggtgttgacggccacgtcaccaaagtagtgaccgatcaaggcgaatatccagctgacctggtcgtaactgccgccgggattcggccagcaactggcttcttgaaaggcgttgtcgacttagatgatcacggtttgatcaagatcaacgaccacctccaaacgagtgacactgacatttacgccgtcggggacgcgaccttagtcccatttgccccaactggcaaggataaccgcattgcgttagccactaacgctcgtcggcaaggtcggattgccgctaagaacttacttggcgaaaacgtaccaatgcctgctgtttctggttcatccgcactttccgtctttgactaccactttgcttccactggtgttaaagaaggcacggctgacaagctgggcgttaagacggcatccgtgttagtcaccgataccattcggcctaaatttgtctctgaagatgctggcaacaccaaagtttggttcaaactaacctttgacccaactgatggtcgcgtgcttggtgcgcaaatcatgtcgaagtacgatgttactgctaacatcaacgccatctcagtggctattcaagctaaactgactgttgctgacttagcttacacggacttcttcttccaaccaggctttgaccgtccttggaacatcatcaacctcgctgcccaaaaagcagccgcaaccttaaactaaatcaattaagccttaatacatcaaacggatccctcagccacacatcgctgaagaatccgttttttaatgcatcaaaatgctagtcatcaagattgacagtataccaagtttattttcagatatcgtttcataaaataccatgctagacgttgtactagttattacttagcatgaatcgtgattaaaacgtgccagttaaattactgttcgtcagccggtgcgcgnnnnnnnnnntgtcacccagcccctccagtcgggaagccgctcgaatggcaaatgaacagccacttaacttggtacaattagtcgctgactatattttttactggaaatttaaacataacgttagggtggcgttaaccactttgtcgagacgtttaattattactatggtgatttgggaatagtaaattatcacaatatcattttctgtctgacagttgattgacaaagttatcgtttataaaaagcaatgacaagtccatcaatgattgggtacatccatgtccgccattcgaacactgtcccgactggaaagcgtttcggccaatgctcagcactgccaagagtgtgaggttcagacgggtgagactgaggattagcctagctagggcgttaagcggtgaatttccgcttgacgtcatagcgtagctaaccggaagtctcagtctgacccgagcacgtttcactaatatgccattaaagcgtggaagaccagtatttaagacgtggtcttcggcttaaatctgtgtccaccgcgttccagcaattggcagaaatacctggaagtcggcgtaggacgcgccaactaagtaattttacgctaactcgaactttttccagcaggcctaagctggctgcttttgaactgacataactggcacgttttaatcacgattcatgacaaattaactcgcataatgcgtatcatgttaataaaaggcggggattcagaaagattaaactcgctgaatccccgccttgataactattatttcaataaatatatgatgtttgagcgactttcatcaagtcagccacgcgctaataaatattaatcaatccctgagttccttgatcacccaagcctttgacatcgaccattacttcataaagtcgtttagcctgcgccgtcgcaaccagattaagtcccatcgcatccgcctcgctcaaagcaatccgcaaatctttaagaaaatggcgggcaaaaaagccaggcgtgtaatcgtccttcagaatccggggcacgtaattatccatgctccagttgtcagcaccaccgctagataacgttgccaagactttttccggatcaagaccggctgccttggtatacaataacatttcagttaacccagtcatcgtccctgcaatcatgatctgattggccatcttggcatgttgaccagtaccagcatccccaaaatgattgaccttgtgaccaagcacattaaataatggtaacatcgcctcgtacgtatcggcatcgccaccgaccatcaccgtcaaagtggcgttttgggcgccaatatcaccgccggacacgggcgcatccaaagcgtgcatgtcatgttcacgcgcgtacgtcgcaattttaacggctaacttgggttggctcgtcgtcatgtcaattaccgtttttccagcggccaatccactgaaaatcccgtgatcaccaaaataaacttgttcgacgtcccgtgggaacccaaccatggtgaaaatcacgtcactcgtttctgccacggcagccggtgtatcagcccaagtggcccccgccgcaactagcgcatccgccttactttttgttcgattataaaccgttacgtcatagccggccgtcatcaggttacggacaatcgctgccccccatgacgccggtaccaatccaacctaatttcatcatttacgcacctttccttccacgcactgttcattgcggcgccgacgccaaaaatgaatcagcaacgtaataataaatgctactaatacgataccaccaaaagccgttgcgggaatatcccaaccaatggcaggaattgagataaataatttgatggcaatcaagacaatcaagcaatacgccatggtttccaactcgggaatcttgcgcattaagcgcataatgacctcggcaatgccccgcatgcaggcaatcccaatcatcccaccaatcaaaacaatcaccggattatccgaaattgccaatgacgccaatacagaatcaattgagaaaatgatatccatcatttcaatctgaatgacgaccgaccagaagttgcttagtccgaagaagcgtcgttgttgcttgggtttctgtgccaccttggccccatttttcggctgactaaagtatcgatacaccaagtacccaaggtaagccgcacctaacactttgatctcccaaaaactgatcaaatacgtgccaatcccaatgattaaaaaccgaaagatataggccccccacaagccatagaataacgatttttcccgctcttgtaaattatctaaactctgggtctgagcagctaagacaacggcattatcaactgatagtaaacactcaataattgctaacgataaaatgattaaccagtcattagcagatgtgatgacgttaccccagttagtcgcactgaagaagggtccatacaactgttcgattaaatataacaaacggcatcctctttctcttaatattagtttgttaatctaagtatacctgtaaaaataattggtgccgcttacgtggactaattttcaaaaataaaccttattttcgtcgtatttacgactcatcatgccaatgagtaaaataagtgcccaaaaagctagccaattgcgacctttcttattctaattgtcgaataactttggctggtaccccggccaccaacgtattatcaggcatgtcatgagtaacgactgctccagccgcaatcacaacattattaccaatcgtcacgccgggcgtaatcaccgctctccccccaatccaaacatcatgaccaatcgtgactggatgaccctgggccaagctagcacgtcgaccactagcccgtcaacgggtgattgaccgtataaatatcaacattggggccaatcatcacgttatcccctatatgaactggcgcgatatccaaaatagttaagttataattactaagaaaattatcaccaacatgaatattacgaccattatcacaattaaagtctgcttgaacggaaagattgcgaccgtaactaccaagaatctcttgaatcttggcagtttgcgcatctggatttgttgcatcgatctgattgaactcttgacataacttggcagcccgcgctttttgagcggccacctcagcatctttaaattgataccattccccagctgctaatttatctaattctgacattgttgtccctcctgtattttatcaccctaattttactgcttagagtggcgtcgaagtcaacacttgagttaatggtttagcaggtgttattgacaactatccttgcggaccagctgcctcgaatttattcagcagttagggcaacaaaaaaagaaaccgattactcaggtttctttgcgccaattctaggccttaaactcacgaattaattgttggagttgctgattatcgttagccgttccgaccgttagtcgtaaccaccctggccgtaagccagtgcgaatcagatacccatggtgcactaaatagtcagccagttgcgtggcactcggatacttaaagaaaatgaagttcgcgccagattgatcgtaagtgacaccctgatcatcaaagaatgccatccacttagcacgttccgtcgcatttttttggaccgtttgtttcacaaaattaggatcatcgattgccgccagggctgccacttgagccaaggaattcacattgtatggaagccgaatagtttgcatcgttgcggcatatttggtattaaaaacggcgtacccgattcgaaagttagctaacccatatgctttggagaatgtccgcatgaccactacattcgggtacttggctggtaactgcatggccgttacttgagccgcgcccggtgtaaaatcaatgtaggcttcatcaatcaggaccatcgtctccgggggtacttgctggacgaacgcttcaattgccgctaatgattccacggtgcccgtcggattgttcggattgcacagccaaaccatcttcacgtggggcgtaatggccttcattaagccttcgaagttcacatggtcattaggcaacgttggcacactgattaattgccccccctcgatctcagcatgtagtccatattctgaaaacgtcggtgcggacactagcacctggtcgttggtggctaagaacgtccgtgataacatcacgatcatctcatcaagacctacactaaaaacgatgctattcgggtcgattccctgttgctgggccactgcttgtcgtaactcctgtgcgtcggcatcgggataacgattactctgggtgaagtcccaattcttcacagcgatcgccacttttggcgaggtgccatacgggttctcgttagctgataaccggactaattctgtcaatcctaactcagcttggagggtcgccaacggcttttcgggcacatagggttctaactgttcaatactagctttcattcggctacctcctataggttcttaatttcgggccgatccttatagtcactcatcttaccttcacgtttagccaattcttgcttaatctggtcaaaactaacaccacgttcgaccaataacactaaaacgtgatacaacaagtcggctgtctcataggttaattcgtcgtcaccgggatttttggccgccacaataacttcggttgattcctcaccaaccttttttaaaatcttatccagtcccttagtaaataaataatctgtgtaggagcccttcttaggcgttgccttccgttgtttgatcagttcgtataattcttccatattttgcatattcgacaccactttcttctataatatattcatcaatttaatacgggttaaaaacaatcctgcttatcgaccgttgggaccgcattttccaaccaatcagccatctaactcccaactcattcggctatcgtcatcaatccttaggcgccctgttctagttcaaccgggttaaagaaacaactcgtatgtcccgtatgacaagcgggaccatgcggatgaactgcgaccaatagtgtatcttgatcgcaatccaacgtcatactaacgacatcttgtaaattgccgctcgtagcgcctttgtgccaaagttcttgccgagaccgtgaccaaaaccacgtctggcccgacgccaatgtccgttgatagctttccgcgttcatccacgcgaccattaagacatccttcgtatccgcgtcggtgacgaccgttgtcagtaagccgtcacccttttcaaagtctggtttcatcttacgaccactccttgttttcttaatgtcgctttgacatctgcaatcgttaactcgccaaagtgaaagacggaagccgccaatgcaccatcaaccggggttgtgctaaaaacatccacaaagtcttgtaagttacccgcaccgccgctggcaatgattggcacattgaccgttgctcccagggcctgatataacttggtatcaaagcccgccttagtgccatcgcgatccatgctagtgaccaataactcgccagcccctaaggcgaccgcttgcttggcccacgccactgcatcgaggtcggtcgcttgctgacccccatgtgtatagacacgatattgaccagctgccgcatcccacgccgcgtcaatcgcaacaacaatgcactggttaccaaatttttcagcaccggcacgaatcagttcagggttggcaactgcagccgaattaatagccgtcttatcagcacccgcacgtaagattcgttgcatatcagcaacgcttgtaattccgccaccaatcgtcagtggcatgaagacctgagctgagacttgttcgaccatggcggccatcgtctcgcggtgctcattggtggctgcaatatctaaaaagacaagttcatccgcgccctgttgctgataggcagctgcaatcgccaccggatctccgacatccgtcaagttgacgaaattaacgcccttcttgacccgaccatccgccacatccaagcacggaataatccgctttgctaacattcagtcacccccgctaattcggccagtgtcacaccgccttcagctaacgccttgccaataataacatccttgaacccactggcttgtaacacttgaacatcggtcaaattccgaacgccaccgctggcaatcaggttggccgtgggcacctgtgcttgtagttcttggtataacgcaaggttagggccttgcatcgtgccatcacgggcgacatcggtcacgataaagtgcttggcaccactcgtagtcattgtcttcattaatgtactcatcttggtctgtgactgctccaaccagcctttaattgccacataaccattggttccgtctaacccaatcacaattcgctcaccaccaaactcacttaacagtcgtttgaccagtcgtggatcagtcaacgcaactgaccccaagattaagcgatcgattcctaattcgagataacgagtcgccagctcgtaggttcgaatacctccaccgagctcgatcgtcccggtaaatgcttgccggatcgccgtgattgtcgcgaagttttctgggcgccctgacttggcaccgtccaaatcgaccatgtgtaattgctgcaagctcgctgcgttaatttgttgggcttgaacgacaggatcaggattaatcaatgtcgcctgtttaaaatcaccttggtagagccggacactctgaccggctcgtaaatcaattgctggaaaaatcatttgcactcaccatttccttaaaagctgctagttgttgtaatccgactcgaccactcttctccgggtgaaactgcatcccaatcacattttgatgctgaacaatacttggaacctggacgccgtgttgaactgtcgccacgatttcagttgccggacataccgcatagtacgaatgaacgaagtaagtataggccgcgtcaatactggcaaagggactatcaggacgccgaagctcgttctgattccaccccatctgtgggactttgacattcaagtccgttggcaaagcgctaacccggccgcttaacaagcctagcccagcatgctcgccgtactcggaactactttcaaacaagagctgcatgcctaagcaaataccgagaacgggtttgccactccgcgccaatgcttgtaacacgccgactaactggcgctcttttaaagcggccattgcagctgcgaaagctcccacaccgggtaaaataactgcgtcagcggccgctaattgttgcgggtcagccgttaagatggttgacacttgcaggtagtcaaaagctttcttcaaattacgggtattacccgtatcataatcgacgattgcaaacatttaaatcacgcctttcgtagagttgaccccctgaatatctggattaatcgtgacagctgcgcgcattgcccgcccaaacgctttgaacaaactttcaactttgtggtgagtgttacggccgtacaggatgcgtgcgtgcaaattcatttcagcagcaaaggccacggcttggaagaaatcttcgactgtctccgtatctaagccaccgagccgcggattcgtgagctcggcatcaaaaactaagtatgaccgtccacttaggtcgacactgacctgacctaaagtctcatccattggcacaaattccgtcccgtaccgttcaattccctgcttatcacccaacgcctgcttaaagcattcgccaagcacgattcccgtatcttcagtagtgtggtgcgggtcaacgtcgaggtcgccgtgacacttcacgaccaacccgaagcgcccgtgcttcgcaaataagttcaacatgtggttcaaaaagcctatcccggtatcgatttcgataccgctctgttcgtctaaattcaaactgatttcaatctgggtttctttcgtttcacgtttaatcgttgcttgtcgcatgttcatttcctcctcatctgctaaaacgactaccggctgtaatcacaatcagtatcaactactaattacgccctaatcgtaataggtgtcaaaacgactctcaatcgcacgagcatggccttccagaccttcgacccgtgccaacgtggtaatcgccggagcttccttagccaaagcgtccttagtgtattggataaaggacgttcgcttaacgaaatcatagacgccaagtggtgatgagaaacgggccgtgccactcgttggtaagatgtggttcggaccagcaacgtagtcaccgagtggttcagaggcgtagcgtcctaagaagaccgacccggcatttttgattaaattcaagtactgagttggattcttcaattgcacttccaagtgttctggtgccaccgtattcatcaagtcaaacatttcttcaacctttgcgacaacggcaatgaagcctttttcgttaacagcgtcggtagcgatcgcttctcgtggcaaaactttcaactgtgacgtcacgttgtcactgacggcctgcgctaagtcggcactatccgtaattaggattggccgggctcgacggtcatgttctgcttgactcaataagtcagccgctaattgccgaggatcagctgaatcatccgctaaaataccaatttctgacgggccggccaccatgtcgatcgccacctgaccaaagacctgcttcttagcagtcgccacaaaaatgttcccaggaccaataatcttgtcgaccgctggaatcgactcagtcccataagctaacgcagcaattgcttgagcgcctcccacttgatagatggcgtcgacgccaacgattttggctgcagcaagaacggctggattgatgccatcgacttgtggtggcgtcaccataatgacttcattaacgccggcaatcttagcgggcaaggcactcatcagtaaagtcgatggataggctgccgtgccacctggaacgtataagccaacccgattaagcggcattaacttctgccctcgtagaacgccaggctgttcagcatcaataaagccagtcgccttttccttttcgtgaaaactcgtgatattgcgtttagctaacaacaaggcgtccttcacttgcgggtccagattgttataagcatcatcaataacagtttgtgacaacttaaagtcggtcaaggtgaccttatcgaattgggtttcgtaatccttgacggcggcatccccgtttttaatcacattggcaataatttcgcgaaccgctgattcaacctttaagtcagtcaattgttgggtcttcgtttgaactaagcgttttaaactagctaaatcttcattaataattttcattagacaaactcctttggattattcgtatcaacaactgtggccaaccgatcaactaaatcaaagatggcggcttgttgctgttttaaggctaaccggttgaccactaggcgggtcgagactggttgtaaatagtcataaatttgtaaatggttctcacgaatcgtggtccccgtctcggtgatatctacgatggcgtcggctaagccagtcagtggtgctaattcaaccgagccttcaatcttaataatttcaacatcttggcccaagcgatcaaaataccgttgggtaatcaatgggtacttggtgccgatgattttgcgtcgtggtgcaacgggatcaaagtcggccgtggatgctagcacaaattggcacttaccaacccccaagtctaacagttcatattgggtactctcgtgttcagtcaaaatatcgctaccaacgatgccgatatcagcagcaccccgttcgaggaaggtcgtcacgtccggccctttcgctaaaataaactcatatggttgcgtctcagaatcaaaaatcaaccgccgttgcttgttgcggacttgcgaacaatccagtccagcttcttccagcaacggcaggacttgttgttcgacgcggcccttagtcaaggcaatctttaaacgtggttcagtcattggtcatacctccagttaaatcaatcagttgggcattcaaacgttgtgcttcgatgcgcgcacctgctaagtcatccgccaaactcaaaatggcgtgcggttgtttcgctaagtatgcctccgcttgtgaccactgttcaggctcaaagtaaatcaattgttcagcataagcggtctgttggtcggtggctaaagtcgttaacaagtcaacgtttaaccccattcccacagccggttctgcttcagcttgaaagttcgttaacagtttgtcgtaacggccgccgctgaacaggtagccagcccccgcttgtgaataaccccgaaaagtcaggccggtatagtatttttgtggtgcttggctactcaaatccaccgagatgacttgctccggcatcgtttgttgcatccaggccaccaccgtttgaagccgtttcagacttggttggactgtttcaggtagtggtgctgccgctaattctttgaagatacattctggacgcccgaacaaacgcggccatgctttgagaaaatcgtataaaggctgtgcgcggtacttggcaatcaacttcgtgtagcgtggtacttgcttatcgaacagtgcggttaaaatggcttgttgttcgccttcgtcaccagtcaagctggccacgacccgttgtgcaaattgggcatctcctaattcgatttcaacagcatcggcaatcagctcacttgaaagctggttggcaatcgttaaacattcaaattcggctttcagcgatgcgtaaccgactaattcgactcccgcttgtgtgatttggttatatgaacctgataattgacggcttactcgaaagatatcgccgacataaccaaacttttgcggtaaggggacattcgtcgcgctaatgaagcgagcaactggtaaggtcatgtccggccgtaagaccaaggtgcgaccatcgttgccaaataagcggtatagttggtagttacccatctgatatggatcaaacaccgcttcgttttctaataacggcgttgcaattggcgcgagcccgcgttgtttaaaatgggcttggatcaccgcgatcaagtgttgtttgatacgtgcccgccgaccaaattcatcccgggttcctagtggtaataagtgtttcaacataatttacgcctcctaaaacgtcgttatttttaaaactaatcagtttaattcatattgttacttatcaacgtgcttaatcaattgcttacatgctaaccggagcgacttgcgattccgtcacgcaaacttaccgcatggatcggtgaaactaaaaaacgcccccttagcaatttgctaaaaggacgtttacgcgtggttccaccttatttcatctaccgttcgcacggcagacctcatgttgatcaagtcaacttggataacgaaaccaattcggctaaggctaatgagactggttcaccttagcagttcatagatgtgtgttcgttaagcctgtctgtccggttctcagctacccgggctctctggatgaggaagacttaattacttgttctaatcacaaccatttattaaaatttgattagtcgtttaatttataattaattgtaatcactaaactgacggctgtcaaccctcaattaatttttttataagatgatagccacgccccacactggctatgtcatgggcatcagagccataaaccagcggaatgtcaagcttttgagcgcgttgtagaatctgttcaccgggataaaaatcattacaatacggtttgtagagaccagccaaattcaaatctaactgccgccgttgctgcttcactaacgccaacgtctgatctactaattgaagattatggacatccaagggttcagtcaagccaaagtaatcctgatatttgcggacgagactcatgtggccgatccgttgtggtgcgtaagggcccagatctgcttgtactgatgccaagaccgtctgataatactgttcaaaaacacgttggggcgtcttaagccactgcccaaaaccggctgcaaaatcatccgttgacatgtcaacacaccagaaatgctgccgtaacccccgcatgaaatggactgacaaaatactttcctgcgtccgaggaccataggtattcagaaaatcacgcgtccaagcaacatgctctggtaagaaatcaacttcaaaacccactgagatctcgatttgcccggtatatttggtcttcagtccgttagccagtgccaaataatcggctacttggttctcacgcaacgacgcctcagtataaccggccggcgtcccttcatactggtcacgaaatgccggtggtaacggtgcgtgctccgtaatacaataccgctgaaaacctagctgtatcgcccgttgaatcattttttccgttgcttcaccactcccatgcggacatagttccgtgtgggtatgcccatccattagcatatcctcatcaccctctcataatttatgcttattcaatcatattttttttagataagcaagtatggtcgaaacggtcattcgcgacaatccgctagcagtcacggcgaaagtctaacaatttacttatttatttatattaattgtcacaatttctttataccatgatatagtcaacattagttaaagaacagcgctattcccaaaaaaggggggaccagccatgcacgaactcattacaaaactttatcaactcgcactttccagtcacattgtcagtacgttgctggaacccgtgcacatcgttatcttagctttacccatcatgaccttactactcgccatgattatcctgactatccagctccgaacacgtcaaacattgagtgagcgtaacttgatcagtacctattcgtttatttggtacttggcagcagcctacttactaattattctgccactcccgactcgctcatccgtggctagcctaacaactgctgagtataatttacaacccttctactttctcacccagttgaaggcactcacgccgtttgaactcggggaccccagtacttggttagccgccttcaaatctgacacgttcttccagccgttcttcaatattctattatttatgccgatcggtgcctacttaaagtggcggcaccgctggccgctctggttgatcaccctgacgagcttctcgatttcattgttcttcgaaaccacgcagttaaccggattatacggctactactcacgagcctaccggatgttcgatgtcgacgatttaatgatgaacacacttggtgggattgtcggtgctgggtgtctacatctgattcctaatcagtggcgcaatcgcgaccacagtacccggttgaattggcaggaacaccccatcaattggcgccgcattggggcgttggtcatcgattggctcgcaattgccgcctttgacaccgtctacttcgtcttagtcaaacattttaattggccattaccacatgattttcgctggctatacctggccgatatcatcctcttcttcattgggcccgcctggtgttggcatggtaaaaccattggtggtcgcctgctcaatagtcagatcgtaaccatcagtggtcaccaggccaatctctggcaactgcttatccattacagtgggctctacttaatcggcctgccacttttattcttggatttatggttattcaatcgtctaggcaatgttcctagtgccacccttaaccgcctggatgtctacctcgtcgtcgtttcagtcattttactgattatcagttatgatttattgttagcgcttttcagtcgcagtcaccagttatggtgtgaaaagttaagtagaacaactgttaaataattaggtggccttaaaacttcctttgcgttgtctcgcaactcatgttaaattgaagatatctcaaaacgctggaagtaaaaacaatgataaaagtccatgaactaagcgacgattttcgctgggtcgctgttaataattacactgaaaatgattatcatcaactcgtaagtgaggaacacgttaccgacgaaatgttaggctacgcaaccgatcaacacgaacgaggccggttggaatatgacgccaaaagtgccatcacgaccattatttttgacgtggtcacagaagacgttgaggaaggtacttataccgcccaagtcagtttcatgttgattgaccacaccctactgacttttacgaccgataacacaatattcgttgaggatatgttggcagacgaaatcgatgccgattgggaagatgtcctgcatccatacgaccatatctttaacgtcttgtacaagctatcacggcaatatttttcggccatcaacaagatcaataaacaacgacaagacattcagatgaagatgaaaaagcaaattcagcgttcggtcattattcaattgatggacttagaaacaacgctagtctatttcctcacgtcccttaaaagtaataacgacatgttgcagtcactcaaacggtttgtaccggtcaaattctcggcggcccaattagaacggctcgacgatattattgtcgaggcacaacaaggattggaaatggccaacattgcctcagacatcatcggccgggtgtcgaacgcctactcgaacattctagacaacagtttgaacaacacgatgtgggtgctgacgattttctccatcgtcctgacaatgcccaacattgtcttcggttttttcgggcaaaacgtcgacttaccgttcatgaagaatccattcggttgggagattacggtattcatcgccgttgcactatgtgccctaaccatttggttgctacgacgcaattcatttcgtaaataaaggaggttttaaaaatgcctagtcgagttaaagtcacggacaccaacgattacatcaataaagctgcaatcgctgcacaaccaatcttgagcacccttgcccaactgattacatcggaattgcttgactttactgctaaaatcaagtggaatttgccgttctatgaacatgacaaacaatacgttagcattgctgcttatcaggcccacgtcagtctaagtatttcagccgaccttgacgatgcgaccctcactgctgctaaaactgctggttacgcaaccggtcaaaagcggctgaacattggcctggatcaacccgtaccagtggcgctagttagacaagtcttacaactaattgcttaaatatacgctgcttttaatttcaaaaggttccgaactgtcaaacaactgacaattcagaaccttttattttggttattcttatccaatatccaagctatcaaaaccagtttttctgtacagtttcatcgattaaactgaaactgctaaggactatcgcttgcgcaaccgataatcctttacattagcaaatcgagacagctcaaccagttgaccggtcgccttcaaatacgcatcatattcctggtcaagaccgggaagaacttcattagtacccggtacaaaatgaatatcctcatgtccggcagccgtagcggtctcataataccactccttaaacttcaaataactcatcgtatcctgtaagtcggtaatccgctgttgtaattcctgctcatgcgttttgagtaattggtaacgatcgtttaatgtcgtatcaccttcgagtctgagcgcaataaaagtagcaatgtcagctactgacacacccgcatttttgagacatacaatggtcctcatcaaatgtagatcattatcagtaaattcacgccggccaattgaattacgcttcacgaatggcagtaatcccgacttatcatagtaacgaatggtatcaatcgtcactcctaacttatcagctacttgtccgattgaataactcatactgaactgaacctcctcgattgtcgtttaaccactatcttaacgcagctaatcgtctgtcgataatgaaaggtcctcacgtgacttaatttcactaacaatgctttgtaaattagcgagtccaccttgataggcaaattcacctaatggcaagtgtgccggtacttctaccaaattggcctgatcaaacataacctgagcaattcggtgcggattgcccggtgcctgagtaaccgagtccgataccgtcgtaatcgcgtcactaaacgcggcgtaatctgcaattgtcggtaccatcttttgggatgaccgccctgaccactgcgttcgagcgccacttggttcaaccgtcataatttgaatccccaagtcttttacttcttgccgcaaggtatcactatacccctcaactgcatactttgtcgcactgtaaaagcccatagttggtagtgtcgtcaatgccaacgccgatgataaattaataattatcccagcatggtgtgcccgcatggtcggtaaaacggtcctagtcacgttagcgagtcccataacgttaacttcaaacatgtagcgaactttcgccatatcactttcttcaattgttgaaaaatagcctaagccagcattgttcactaaaacatcaatagttccaaaacgttgaatcgcttgagcgaccccagttttaatttgtgattcatttgtcacatcaatgcttactttctcaatacgcgtcgcgtcaaaaacatctaggtaggctaaatcatcggtgtggcgggcagccgcaatcagctgagtgtcagactgacgtgcaacaattgtcgcgagttcctttccaaaaccacttgaagttcctgtaataaaccatgttttcatcttttaatcactcctattaatcttgctgagctactactttactcagtcatagtccttttagcagccttgactaacccatctaaccagctttggtgaccatttagcatcggattgggtgtttgattagctaagtctttagcaggctgtccaacttgcgattcttgtgttaataatcgaatccggccatctgtcaatttttcaattaagaaagcgtgatagacatcaaattgagtatctgcatcaccattttgccagccatgccatgctagtcgtgctgtttcaccatccgtcggttcaacgagttccatgacctgggcatcgataggaaaaccaaatgtatcaaatcggaaatgttccgcaaactttagttcagtattcgtttgatcatccaaaataatgttagtcgcattgtcataatacgtcgtccacttcgatgtatcgactaaatttttccaaacagccgctaaagtcacaccgtctgtaatgacctcgtttgacacgaaattatcagtatgccctggtaaatagtccgttgaccaattaattgatttcattattaattcctccatattcgcgttaaaattttattctagctagcaaattaacatcatgacatctcattgaccattcactaactttgaataaacttagcttatatgctggagctgactccaggacaaggataaaggacactcatcagttttagcttaacaaattcttaatattgctttctaaaacgaacctaatttcaacatgacgcttattatattttatctgactctaacgctcgaataattcgacatcaaaaaaagctggtcgccagaatattgattctagcgatcagcttttcattacccttaacaaattagttttattgcatgtgcaataaacccatcttgtccatggtttccgcaatctgaactgagttccaagcagcaccctttaagaggttgtcggaaacgttccacatgtggaaggcttgtggcgtttcttggtcaggacgaacccgaccaacgaacgtgtctttagaaccttccgcattatgcgcttgcggataaatttggttatcagggtcgtcttgtaagaccacgcctggtgcagctgccaaagcatcttgaatgcccttgacggttgccttaggatcttcaacttcaaagtaaactgattcggagtgactcactggcaccggaatccgcacacaagttgccgttactttgatatccttactgtccatgtcgccgccacacataatctttttggtttcatggctcatcttccattcttcatgggtgtagccatcttcttcaaacacgtcaatttgtggtaacgcattgaaggcaattggataatgcttcttgtcgcccgcaacaggtaagatatgagcttccatctcttcaccttttaagtaggcttccgtctcatcatgcaattccttcaaggcccggttaccagcaccaccaacggcttgataggttgaaacaatgacccgcttcaaaccaaatgccttgcgcactggttccaaagcaacgaccatttggatggttgagcagttcgggttagccacgattccatgatgaagcttcaatgcttcagggttaacttcaggaacaactaacggaatctttgggtccatccggaaagcacttgtattatcaacaactacggcaccccgtttgactgcttcaggggcgaacttcttagatactgagccacccgctgagaagagggctaaatcaattccttcgaatgattcaggaacggtctcttcaacagttaaggcttgaccattgaactgtaattgtttaccggctgaacggcttgatgccaaaagtttaactgagttgacaggtaaactcgtctgttccaccattttgatcatccgcgcgccaactgcaccagttgcaccgacaatcgcgacgttatatccactcactatgaagacctcgctttgatagttattgaaacctcattatagcacgtttgtaaagattagaaaataatgagttccatccgaccataaattaatctgtcactgattgcactgccagctgttttgcacacgcagatcatcaaaaaagtaaccgttaccatcgttaattaaacagtcatttatctgtcgcctattttgacgtataatgaacctaattcaaaggaggccgcgccatgtgtaccagcttaacttatcttgatactgacaatcaccgctacttcgcccgcaccatggactttccaacaacgacaccttggcggccaatttttttgccgcgccgttatccgtggccaactgggttagcgacgacgcgtatgacgcagtatgccattctcggtggtggccggctacctgaccactttaaggcttgtttgatggctgacggcattaacgaagctggtttgatgtgtgctgaactgtacttgccccacgccgttgaatacgccactcaaccacaagtcaaccaaattaatttaacacctcaagccttcatcaactgggctttaggtgaacaccaatcagtcgcagccgtgatcgccgatctgccaagtgttaacctggtcggtgcgtcctggggtgatgacactggtgaagtctatccctttcactggtatctcagtgatgcacacaccagtgtcgtcatcgaacccactggtggcccactgactgcgcaaccgaatccagccggcgtcctgaccaatacaccagtcctaagcgaccatcagcgccgactaaatctttatttagcaatatctggcaaccagattacaactgccactcgtcaggctgctcagcacgtgattcagactaagcaaccattaccgagcgggccgattcccactgatcgtttcattcacatggcacttcgacgactgggaacaccgcagttagcaccgcaacaagtgccgaccactttattccgctggttacaagaagtaagcttgccataccacgccgaccgtcgccatctcatcagccacaactacacgcactatcgttgtttgatcacgttagcgactcgtacttaccgctttattccacgcacgactggtcacgaacaacgactgacactaacacctgaaatggcagcaacctggcgaacaccgtacctcttccctgccgattgaaactaaaaaatcacgatgttgagactgaactcacatcgtgatttttaattaatgacgctgcttcaaaaaatgatcaaattcctgattgattgccgctcgtacttggggctcatgtaaatcagcttgcgctgcattcggaccacccgtaacttgactaaccacttgcaaatagccgaacaagacctggctgggatcaagatgatactgcttggctaacgtcacggctagatcataacgatcaggtcctaataaacttgaataatccattatgccgtccctcccttcgcctgttctagctggcgactcatccgtaagtaggccaaaaagtgaaaaatgatgccacctgctagtaagattgcacctaaccataccgaccaaaacgttgccacgatggctaagccataaatcgtgacacttcgaaccggatcaaacttaattgcggcataaaaagccattgagattcccggcttctttagatcctggtgatgatgcagataagcgtacatgaaataaaatgtcgccgaaataaacagggcaaccaaatcataaacgataaatgccgtttgcatatcctgtcgattaccagttgtcaacgcatctgccactaatgacatcgggtaatccaataaggtgatactaaagagcattaataagtttagcatattaacgttgcgatcaattcgttgtagcatgttgaaataatcatgatgaaataaccacagcgtgccaacgtagaaatacgaaaagacgtacgacaagatcaacggccattgcgctaatagtgccgccagtaaatgtcccggttggtaatcgggaatgtgaaattctaagactaaaattgtaattaaaaggtagattgtaaaattaatnnnnnnnnnngattaaatttgcaatctaccaaaatggcaaaaataccatcactgaacgcctgaaatcgatctgttttcaaaatcagcacctcccacagcgttttaggataccataactcacaagtaattactgtaattaacttttcaaactgacgaccaaaccgcttctctaacacctgatatggtaagattaagtcaaaataaagtaattgatgtgggggcgtcaagacgaatgcgaaaattattaaaaccaaagtggttgttcttatttttctggggaatcgtggtgtttgcaagtattctgattttaccgaacattaccaggtttgtgaatgaacaaaccgcaatgccacaagatgcaacaacgagtcctaaatatcaacaacaatggggtcacgggttaaccaacagccagtccttaacgttagtcttcaacaattcaaatggtaaattatccaaacagcaacgccaacaaatctccacgaccctagccaaacttaatcgccgagccgatgattatggcattaaccagcttcgaacgccaaccggtatgactaatgaccggcacttattacgttccaatgatggttccaccgaattagcccttgtcgccgttcagacatcccgggctgacctatctgtgattgcaaatcaacttaataatgcgattgcaatcgccgacctcaatacgagtgtcaccagtacggacttgatctaccaacaacacgtgcaacaacaacgtcgcaacttgctgattagcatgcttgtcggtagtctgctcagtttaatcattctcggcctcatcttccgctcactgttagtgccattactgaacttactgtgtcaagtggtcactctgatcacaacgattagctttatcactaacgcgcgtttagcttggcattggccactgacggctaatgcgctgagccttgctggtctaatcagtttaatactgactagtctattgacatggcactttatgtacgcgtattggcaatcgagcgcaccaaccgcaccgaccactgtcagtctcaaaattctgacacttcaatatcgacagtgggcacttgtttttatcccattaatactcataaccatcactttacactggactgccttcatctcattagccgctgcttgggccattactgtagcgcttggaatcaccttactggcggtaccgccgctcaattacgcctttaccgcttggctcggtgataatttattttggccaggaacaacggcttggccgacccgtccacgcaatctatggggccaattgagcaagttcggctactggcagccagcgcttgggagcttggccgtcgcactgttactactccccggcctcattcttgctaacggccagtttgccgatgacaacttacgaccctggcgccaaaatcagcttagtaatgctgaattaggtcagcaattagtccaagctcacttcggtaccggtgccacggcgccaatcacaattacactacgagcaccgcagaatttaacgcagcagcaatcattacaaacaatcgatcacctgacgactaaactgcgggccgtaccaaatgtggctcaagtcatctcagtgacccagcccaccggccaaccactaagtaatttctacgttaaccagcaacttgcgactatcaacattgatttggctggtaaactgacgagtatggcgaaactcaagagccaactcacgactgaccaacaaagtctggaacaagcagcgactagtcgccataccaagtcggtcgaccagttgtccgaccgcatcaatgatttggctgaactgaatgatcaagtgcaacggcaattacaggctattgacacgacgctaacgacatcagctgaggctgaacccgatttaaccaaagtcaatcagcaggtcaccaagttagatcacctgactgaccgcatgacaaccgcactaaatcacgtggtaacggcccaaactacggtcgcaaccgaagctggacacgttgatcagcgtgttcaccacgtcaaccaatcattgaagcagaccgttcaacccttaaccaccttactcgcttcactgaaaaatacgaagacctatctacatgatttagccgctagtcaagttggccggagtttttacctgcctgctaacgcggctactaatcaggcctatcaaaacagtctttttactaatattagtagtgatttaagcatgacacagctaacggtcactttgaaatcagcgccggctagtgcggctagtcgcaggaccctgcaacgacttcaggcagtcacccacgacagcctactcgccacgcccttagcgcacgccaaaatcctaacaaccggggtaacacagcaacagcactatcagcataccctgattgcgacccacgcactgagatggctcacactcggattaatcatcggcatagttgttttatggttcggcctgcgttcattgaccttcagtctgttaatgaccgcgtgcctaactggcgtgacgttaactagttggggttggactcagttaatattaacacgctggttgcaaaccgggccgctcagtagcagtgtcttgcttggtagcttgatgttgttgacactgcactggctaatgattaccaccgcaaccagttaccgtcaaagttggttacgacacttggaacccactcaactgcagcaacacttttatactagtggacgatttgtttgcccggtaacaatgattgaattgacctacttactgccactgcttttgacgaccgcaccaaccttaaaggggcttgcactcatgagtctcattgggattacgataagtaacctcatcgttccattgggattttcagggtggacacgttgggctaatgagccaccagctatagccacgctttggcagcactttcgcccatcatctaccaaccgctagcaattgattagcctaatctttgagtaaaaaaaattgcttttccagacgtcaaatctggaaaagcaacttttttacaatactaaattgaatcgtagcaaactgccagtcgtttatacttaatgattgtgtgagcaccggtaatctgatagtcaccgctgactaactcaatatcgtcatactagcaacgacaaagactaataaggtcatcgccatccgccattcactgtgccaaagattttgcgtgtgccaccacacagctaacaatctccacatcagctaactagaccatattgcttaatcgtaactcacacgatgattcaaatttattgattgaaattctgaactgaccccgtaaacaatgttagctctacacataaccaaaacaatgccccagaaaccataaaatttctggggcatcatcaatccctacatgatactttaataaatcaattcatgcgtcttcaagcacgacggcgataaccgattcccaccgcggcaattaacaagcccaaaagcccggcaaaaatcacccaaatcggcgactgcttctctctggtttgcggcaaagttccgtggttatagccagctgatgtgctttggtcactaccagttggcgttccaaagccgttcataccagttgtcacaccattatccacagtgccaccagcaccattgacacccgtgcttggttgcttgatcagtcctggtaatgccggttgacctaatccagattgtcccggtttaggtgcagcgggttggcttggaccgggtacagctggtcgttccggttgtggcgcggttggccccgtggttccagggttacctggctcagtcgttcctggttcgcctggtttgcctggtttacttggttcagttgttcctggttcacccggtttacttggttcagttgttcctggctcacccggtttacttggttcagttgttcctggttcacctggttggcctggttcagttgttcctggttcacccggttggcttggttcagtcgtccctggttcagtgactggttcatcagttgctgctaccgttaccaccgccgtttgatccggcttgattgtaaatggtaacggtgccgcattaagctgatagccactaggcgctttagtctcaacaaattgataatcgccagcggtcaaaccaaatacagtaagttgacctgtggtatccgtcgttaatcccgtcttgagcactttgccagtggcatcttgcaattcataaacggccccggctaatgccgccttggtcgtggcatcagtcttggttaacgtgacatcaccagttgtcggcacaactggttgcttgacatcatcctgactcacctgaaaagcaacttctggctcaataccgccgagagtaaattttactggagtggtattcaattcatacccaagcggggccttggtttcaacgaactgataatcaccggcacgtagatttttgacaatcaattgtccctgcgaatcagtcgtcaacccagtttggattaccttgcccgtactatcttgcaattcataaaccgctccagccaacacggccttggttgccgcatcatgcttcgttaattcgatggtataggtcatccctgctgttccattgccaccataggtaatatcggccgtcgcatcaacgcctagtccgtccagtgcagccgtattatgccatttagctgtgtcagccggattaaaattctcaaccttagtgttataagtaatcacaaacggcgaatgaatgttgttaaacgtaaaagtaatcacgttaccattagttgcaacagtcggtgttaacggttgctgtggcacttggataccattgataatttgcacggcctgtgccgcaaccgaatctggaatgaatgtctgattgggccctagcgtatctgtaaccacaaccgtcgagttattgcccggtgtcacggtaatgtgccaccccaataccgttggcgcaccatcacttcccgacgaaacaaccaagccacttttagcaatttcggctgatccttccgtcgccgtcgcattgcccttcgcattcatgctcagtgtgccagcccgactattgagtgtacccaacgcatccgtaaacgtgatcgtcccagtactggcacctttcgtatacgtaaacgtgcccaaggtttgcccagcagaatctgttaacggcatcacaacatcatgatcgatactgacgtacgttggaatctcaacggttgctgtatcaccggccttaatcacttcagaatctggaatactccaatgatacgttaattggtagccagccttatcattcaacgtacttgtgtcagtaacgggcttgccattcgcatcaagtacgatggcattgccagccgttaaacccgtaacactgatttctttagcatgtgcagtactccccagcataaatagcgctaatattaccgtcaacatgcttagcatatacccaactagctttcttcgcatacgctcctcccccattcaaaaaaagctttgtctttgtcattctcacaacccaacacaccctcacagtcgcgtatgattgtcagggtcggccaccagttagtgattcacgctaatcagctccatatgtacaatactgcaaccaactagtttactacgaatcaaaacttttatttgcgaactatccgaactaatcgtttagcaaaaaaggcctctagaactatgcctagaagtctaccggaaattccatttacattgtctcgctaaaaacagccacaaagctaagccttaagttgaaggcccctttattctggaatatgactcgaatcaacaacctaaccaactgaaagttacgccaatatgcttacgataatgccaatatcatcgtctgatgtcgcaaacccgcctccataaacgggcgcccttgtggctgataccctaattgtgtataaaacccttgtgcagtgacttgagcgcctagtaccaactgtcgccaaccacggctcagcccatccgctgcaatacgttgaagcaattgccgtgcatagccctgccctcgcgccgctttcaacgtagcaactcgttgaacatgccccgtccattggtcgctaggtgtcactcgcgctgtggctaccgcctgcttttgatcatcatacaagacgtagtgccacgtcgctggagtgaccatatcaatttccaaagtttcatcgatatgttgttcctgcacaaagactgcccgccggattgcaatggcatccgcataaactgatgaatcaacctggttactcatttttatctgcatcacgttatcacccgttcttctgaaatactttgagaatacgcgtttcaccggttatcgtcaaactaactcgaaacgaaattaacgcattcttaaaattgttagcgattacgagttccgatgttatgttaaaatgatttgatgactggttatcgagtcatatccaaatttgttaaaaatgaggtctttatcgatgtttaccaaatttcgccaatacgttaacacgcgaattggatttttttggctactagtcttcttattctgggccaaaacgatctatgcgtacttaaccgaattttcactaggcgttgccgatccactccaggcattcctgatgctcgtgaacccgattgcaacgacggtctttctgtttagtctggcgttctacattcgtaaaaccggtgtatattactatattttgctattcattgatgcactcgacaccattttactgtatgccaacgttatctaccatcgtgaattcacggatttcatgactgttagtacgattaccggcgtgtccaaggtcagtcagggacttaccggctcatcgttagccctagcgagttggggcgatgttctttactgggcggatattattgtcattctggccttggtcattcttcatcggattaagcaagacacacgaccaattaagaaacacacggcctttgcgtacacctctgccgcgattgcaggtttcggtcttaacttgaccttagcagaatccaaccgaccacaactactaaccagaacgtttgaccgcacttatatcgtcaaatatcttggtatagatgcttttacagtctatgatggtatcaaggatgaacagaccaatcatcaacgcgccagcgcaaagaaatcagaattagataccgttaaagattatactgaatcacactatgccgcgccaaacgctaagatgtacggtctggcgaagggtcgcaacgtcattgtgattcatttagaaagttttcaacaatttctgattgatcagaaagtcaacggtaaggaagttacgccgttcttaaataaactgtatcatagcaactcaacttacagttttaagaactttttccaccaagttggtcaagggaaaacttctgatgccgaaaatatgcttgaaactagtacttacgggctctcaactggctcattattctcccaattaggctcagataatacgttccaggccgctcccgcgattctaaaccaacgggccaattattcctccgccgtcttccacggtaacgtggccagtttctggaatcgaaataacacgtataagaatatggggtaccaatatttctttgatgccagttatttcgatacgactggtgataaatcaactggatatggtctaaaggataagctgttatttaagaattcagttcagtatcttgaacggctacaacaaccgttctacgtcaaatacatcacggtaacgaaccacttcccattcacacttgataaggaagacacgacgtttaagacaacggatactagtgattccgccattaacggttacttccagaccgcccactacctcgatcaatccgtcaaagaattctatacctacttgcaaaaggctggtttattaaagaattcgatgatcgtactctatggtgaccactacggcttatccaacagtgaaaactcgaccttggcacctattcttggtaaatctgcggacgattggacttcctttgatagcgcccagcttcaacgtgtgccattcatgatcaatattccaggaatcaagagtggtaaagtcgaatcgacttatggcggtgaaattgacgtcctaccaacgattctgcacttactagggatttcaagcaaacgttatattcagtttgggaccgacctcttctctaaacaacacgatagtaccgttgcgtttagaaatcgcgatttcgtcacgtctaaatacaccgtccttagcggcaaaatttatgacaacgcaactggcgaaacgattgatgatgatgaggcagttcagaagactgttgataaagatcagaagaaagtcgacaaagaattaagcctctctgattcacttaacaataaaaatttgttacgtttctacacccctaagggcttcaagaaagtcgacgcttctaattacaattacgccgatggccttgaaaaagaaattcagattcaaaataaattagctggcaagtcaaccagtctctactcgaagaatggtaataagtcaacagactcgttgtatacgaccgacgcaccggaagcttcgcataagaagactgattctactcgtatcaagattaccaaccctgatgatacggatagtaccacgactagctctagcagttccaaatagcaacaagcattccatttacaatgcaaggcgcgacggcaatttatttgccatcgcgcctttttatgatctcctttaaatatgacgctgccctcacccatctggcatcgttttcatgataaaatactgattacggcttgtctcatgcttgcgcattaacgatgattacacgtgccatctcttaagttcagtggccgttcatcagccattcgcacggattaccgaaacgtgctcggtagccccattatgcttagttgaaagtggtttcctagagtgactaatctaagcaattatttagataaaaataactaacacaatgcgtgttacaataaaattaataatgacttgattcgtcaatgccggatcaagggaggaggcaccacgcatgggcgcttggcgtttttggtgggatagtacccgccgtttttataagaactggggcagttacgttgccctgatatttagtaccaatttggtcattagttacctagcaattcctttttttaattgggtgctagaaatgttactcaagtggcaacgggtcagttatgtctcgtacacgaatatcggtagtattattattcaccaaccactggccgcactcggtatggtggcgatcttattagccattattattttagtttattggcaatttgcctttctgctactgggtattatgaatatctttcgtggtcgaccacaaactgtgtgcgcggtcttgcggtcaacggtcactagtctgactggcacctcacccagcactttcttattctttatcggctattttattgtgattttgccatttggaagtttcatctttacaacaccattactcaacaaggccaaaattccagccttcattgtcagctatctcatggaaaacccgtggatgacgctcggcttggggtgcttctacttgctggctggttaccttggaattcgcctaattagcctattaccgctaatgattgtcgatcggcttccatggaaaacggccgttactcgtagttggcaacaaacgcgccaccatctttggcgctacttgtggaccatgattgtgaccttatttatgatttttctgatcgttacgaccatttatacgttgatttacgtcgcccagcttcaattcgataaaacaagttttgccatggccgctgccactgttaatctctttatcatggaagcaatcaccgaaattattatttgttataccacggccatcttcatgatgttaattattgtttgctatcgtcaagactttacactcctccgccaacaaccgcaatactttaacgaggcaccacggttgcgcaaattgacccgggcgagtgttgcaattggcttgctgttagcaacaagtttgctagggtccgtctgaaaactannnnnnnnnngttttcagacagtccctagttgccgttaatttagtctacttaaatggactagtgattaccaagccaatcatgatttcccaccgcggcgtcgataacggaaacggcgtgcaaaacacaattcctgcactgatcaagaccagcaaggaacatccggattacgttgagatggacatccaagtcaccaaggaccatcaattcgttgtcatgcatgatccaaccttaaaagccttagctggcgttaagaaaaagccatctcaattaacattaaaacaactagaaaaaattactgttcgtgaaaatggctatcaggcaaagattccaagtttcgatgcttacctgaaagcggctcacaagcatcatcaaaaactattagtcgaaatcaagaccagctcggcttacaccgccgccgatactaaacggttcatcgatcgttatggtgtgaccctactggctcatcatgaccaagtccatacgcttagtttcaaagtcatgcgtgacttgaaacgcttagatcaaaaacaattcgttagttacatcttgccttataatctcacgttcccgcatacagtcgcgaacggctacaccatggaggtcaccacattaaacgaccaattcgttgacaaggctgaccgcaatcacaagacggtttacgcctgggacattgataatacggaccaaatggatcaaatgatgttcatgggcgtcaccggcgtagtcactgataatctaacggaaatgcagcaagaagttaagagcaacaccgaccatcccagctatgccaaactcttattgacttttatgaatgaattaagtctaactagcaacgagtaatccacattatttcaaaattgctgtcacagcgagtgcataaatcattcagcaaccacgaaaattctgaatgatgtcgttgctgaaaaagtgacttccagctgatgacgaatcgtaagcgccatctgaatgcataagtgcatttggatagcgctttttttgatctgattagccgtcgcggtgattgagatgttggtaaaaaactgtattaaagtgcgcagcgctccgggttatctgccattttaatttctaaagcgcacgaatgccgatagttgatcagccactgatttttaatacttttaccgccaattaggtgatcatatggaatgacccagaaacagggtctgaaccatgaagtcctttgatgacagtacgttatcagggacgtcaatattagataaaaaccagaaagagccatgagttatcatgactccgtaagcaacagattggtagcagttcgtcctacttttgcttgtgtctcaacacaacaaccgaaatacccaaaattccaagaactattggaacatcgattgcggtaaccggcaatccaaattgcgataaaatgtaaatgaagcatactattaataaaacaccaccgtattttttaaaaaaaccgataattacattgtctggataacgcttttttaaatacagtaatagaaaaataaaacacaaataaagtatcgtatgcttcacaacacttagtgacatataaaatctaatcatctaaactaacacaccatcaataatggaaccttttgccataaacagaatcatcctctcaaattctacgttaacaacaggcagtatgttacgaatttatcttaacaacagcgtttctttatcgttatcaattttcagtaaattttgtgtatttttttgtacaaacttatacggtagattgtaaaattaatccgaagccggatttaaaattgaagtgnnnnnnnnnnttaaatttgcaatctaccatacattgtaaaagtttagccggagcgaccggttgtttttttattttaagacacaccaaagctatctagattaaaaaaacatttgcctttctaccacttcatggtacaacaggccgccaataaagcgggttcttaaaggaacaagcaaataggacgagaagccaagattcggtttctcgtcctatttgcttgtatagcgccagttatatcgcagctcttttaaacttacattttttcaaacacggtcgtactatgcagtggactccgtcgttcgggatacaaggtcatcattaactgattgaccgcgttaggagcttccccgaagccactggcaatcaagcctaacttgcccgcgtaagtcaccgtatcaccaatagccgcaatcccaggtacgtcggtattcatctccgtatcaacggtgatgagtcggtgcgccatggttggggtcacgtgccagtttcggatgactttattatccgcgataaagccgtagttaacaatcaaatcatcaacggccaatgtttcttcagttgtgccgcgaacctctttcatcgtcagctgtaactgtccggtagccgtccctgcaagttgcttaatcaaaaatggcgtcttgatttcaacggaagacgcttttaacaagtccacattgtgttccatcccacggaaccgatcacgccgatgcatgatataaacgtgcttagcaacgggttcaagcatcaaggccatatcgatggctgagtcgccaccacccgcaactagtaccgttcgatccgcaaattgcttgacacttggaatgtggtagaataattgcttattctcaaattcagccgcattatcgactgctaagcgccggggttcaaaagccccactcccagtcgctacgataatcgctttggaatgtgactgctgtccactcgccgtggtaatcgtgaaatcacccatcgctcccgtgacatccgtcaccgggctcgccaattgaatgtcaattggaaattgtgtgagttgcttttcaagttgtgccaccagttcacggcccttgattgccggatatcccgcaacgtcatgaatgatcttctcaggatacaaagcctgaacctgaccccctaattcggggagactttctaataactgaacccgcgcattacgcataccagcatagaaggctgcaaacatgccgaccgggccaccaccaataattgttaaatcatattctgcactcatcgtttcccagctctcttctatgtagacttattgcttctcattctagtggattcggcgaaggtttgcaaaagcaatttttactaattcgactataataggattcaaaggcgaggtggatcagtgatgcgacgaattaaaattattaaaatcatggccattattagtgcgaccctggtcgtagggattggatcctattggcaacatcgcttgaccccattacgaaaaacgcgggtcgcccaaacgagtattccgaccatcttcgtcggtggcgattacgcgcgcgcattttctaccgacggctttgtgcaccgcttaaccgcggcacacctgatgacgaaaggattggtcgtccatgttagtcacgccggccacgtgaccgtccaacagttcggaccactaaaaaacaacccaacgattcaggttatctttgccgataatcatcatgcgaaacgtcaagctcggcagtttgctactgtcatgcaagggctcgcaaaacgctaccacgtgacccgctacaatgctgtcggtcactcatctggaggtaatattatctttgattatctgacagcgcaagtcccccagcgcgcacaaatcaataagtttgtgaccattggctcgacctatccgggcttgaccactcagcagttaaaccggttaccacggtccttgccgatattgaatattgccggccatgtttggcatacaagtggtgatggcggcgtcaatttacaagccgtacttaaattcagccatcaattattggcagctggttggtcaccaaaaacccaaatcattcacggtagtcccctgaccgccagccactcaatgttgcatatcaatccacaggtcgacttactcatcatccagttcttgtacggcaactgatcaattcatcgaggcgtgctgccaatcaacctgaagcacgccacacttctaatttaacaggattcggacacccttacgtcccttggatgggatggcaaatggtgtcttttctggtatcctaaaacatcacatatcagttaataacgcaatcacaaaaaagtctgctaaatctggccgcataccgttagttaagctagcaaacggtgttttgtcagcgatttttatgtacaacggtggtaatgtatgggtatatcttaatggaggcgattaccatgcgcaaaaaatggcgatggttattattagcacttactggaattttctttttgatgttcgggccacccttagttagtcaggcccgcaacgtaattgaagcaacgggcaacgatgttaatagtgcggttatcaaagatagtaagggcaagataatggctcacgatgcacaattgccagaagaccaagaatacacagtcaattacaactggcgcatccctgataacctcaagatcaaggcgggcgacacgatggctttccaagtccccgaaaacgttcgtattccgcatgacgaggcttttccaatgaaaggaaccactgcaggtaccatcggaaccttcttcattgctgccggcgcacatacgggtctcgtcacatttaatcaggcctatcaaaccagaccacgtaatcggaaagggtttgttcaattggacgccttcggaaccgttcctagtcatcctggtaacttagccccaattttattagagaaatcagctgaatgggctgacgaagctaatccacggcggatcaactggacaattcgtgtcttgcctaataacaatcagctcgtcgatcccacctttgttgatacgttgagtccgaaccaaacgtatgtcaatggcagcgccgtcctacgcgatgagacaggtaatattattcccgtcaatacgagcgtgaatggtaatcaattgacgtttaatgccacagggtcgtttacgtcagagttagctttgacctaccaaactaagactaacgaacccactggcgacgcaacttttgaaaataatgtcacctatactgacaagaacagcaacaagggatccgcgacagccacgatttcacggccagtcaccgaaccggacgttcccgaaaatccaggtatttcggaaccaacagatcccgatgaagatgaggaaccaggagttactgaaccggaaaaacctgggactaccgaannnnnnnnnnactgaaccggagaaacccggaatcactgaaccagaaaagccgggtaccgtctcaccagaacagccgagtggtcctaagcccaccaatccaggaaccgtaacacctgaaaaaccaacggccgtcactccagccgttccaaatgagtcgtctccatcgacccccgaaccaagcgtcagtggtaatctgtcagcacctgccaatccagcgacaaattcgactaacacgaccgccacaacggttccggcaactaatcccttaccagcatcggcagctacagcttttgcaggctcagcaccgatgaataagtcgttgccacaaactaacgaacactcggcaagttggtcagtagctatcggtctcgccttattgattggattactcggtagcgcttttgtcctgacacgccgaactaagcatcggcattcataattagcttgtcacaccgtcaaaaaaatgagctgctcacgtcgcgttgaactgacgatcaacggtgtgagtagctcattttttataatttcaacttgctgctagtaacactgcgcgatactttgttagtcggtctcacgatctagttgctccagcgccgtttttaattgtgcttgcgcactcgcatccagtgagggatacgctaatggcaattccgacaggcgttgattgatgatttccgaaacacagagccgcgaataccacttactatccgacggaatgacgtaccacggtgtcgctttagtagccgtcttggtgatagcatcatcataagcacgctgataatcatcccaatactgccgttcctgaatatcggcagctgagaatttccagttgtgacttggaatttcaatacggcgaataaaacgttgcttctgttccgcctttgacatgtgtaagaagaacttgagcactaagtagccgttgtgttgcaagtaatcttcaaagtaccgaagatcgttaaaacgacgttcaaaaaaagcatcatccacttgtttcttatcgttaatctcaccgacgtgctcattcacaataatttccggatggactcgactaacaagtacgtcttcataatacgaccgattgaagatcccaatcatgccgcgtttggggacccgatcatgaattcgccataaataatcatgcgcaatttctttagtagttggttgcttgaacgatgtgacttcacagccttgggggttgaccccactcatgatatggcgaatcatactgtccttacccgccgcatccatcgcctgaaaaatgactaaaacaccaaatcggtcttgtgcatataacttaccttgcagctcagtcagttgcttaatattcttggcgatttgcgccttgatgaccttttcgtcttcaaattctggatcaaccgccgttgctaatttagttaatcctaatttttgctttccagtatatcggtagtgcttttcaaaattcacgttctagcttcccctcaatattatcgataatcaactaatgtcgctagcggctgatgatctgctggcttgccagcaacggccgctttgccaattgaaacgagcaatagtggccgataccgctgggcgtcaagttccaaaatagacgtgaatccggcagcatcaaacccggtcatcggattcgtatcaaagccatgatctttagccactaacataaattgcatcgcaatcaggccagcatctagggcgccaatggtctcgtcaccagtatcaaattgttgcccctgactggcctgaaacgctggcgcttggtgttgattttcacgatccagcacaaataagacgacggcactggccgtagttaactgactggtattaccagtcgcggcacacaaccgttgtcgcaaggctgcatcctcaatcaccaacgcccgaatcggttgttgattcaatgcggttggtgccaaaaatgcggtctgtaacatcgcggccattccttcacgcccaattttagtttggccgtcatattgccgaaccgaatggcgcgcattcatgattgcttctaatggactattcgtcgtcatcagcttcaccttccttaattgtcagtataaaacagccttcaacatttcgccagtaagcgtggtcgtgaaatatttccgaacatttttctgttcaatgttaatttaattcgccgctagccgttgtcagcatcagctgaaacgtttacaattaaaacatagctttatagcgcttcagacctaatcagggaggatgttttacatggcaaaacgtaaaatgattttagacttagacaccgggattgacgacgcaatggccattgcctacgcagtcggtgcacccgacgttgatttaattgggattatcagttcttatgggaactgcctagtggatcaggcggcgattaacagtttacaaattctagaactactaggtgccactgacgtacccgtctttctaggtgaaccccactccagtacgacggaacactttgacgttatgccgatttcacagcagattcatggcatgaacggtatcggcgacgtgaaccttcctgaaccgaaacgcgccgtggaaaagcagtccggtgtcgacttcttaattgatgccgttcaccaatatggcgccgatctgaccctagtgccaaccggtcccttaaccaacttggccgaagcactcgaaaaagcaccagacattgccagcaccattggtaatgtgaccttaatgggtggtgcactgactgttccaggtaatgtcagtcactacgctgaagccaatattaatcaagatgccgaagcggccaacgccgtcttcaccagtacgatgcctcttacgatggtcggactcgacgtaacgttacggacattattaaccaagactgaaacacaacaatggcgggacttaaagacaactgcgggcgaaaaatttgctgacattgttgactattacattgcggcttacgatattacgagtcctgacttacacggttgtgccttacacgatccactggcagtcggcgtttcactcgatccaagttttgtcaccacgttagaactgaatatgtacgtccaggctagtggtgaagattatggccggacaattggtgaccctgcgcgactcaatgacccaactaacgtcacggttgcgttaacggtcgacaaggatcgttatttgaagacattcatgaattacctgacgacattatttaaagcccattagttatatttcatcatggcaaccggatcacagaagttcgcttccgtgatccggttgttattatttatttacaagtctgctaatttttcatttttccccggcaatttatgttaaattagcagtatcaccattcagaaagtaggtatcgccatggcacaaaaatattacgctgttcgtaagggacgccaacctggtatttaccgcacctggcccgaaactcaaaagcaagttagcggttatccacaagcacagtacaagagcttcacaagcgagaaagacgctcaggattttatggctggtaaggccccagctcactcaaaatcaatatctaatcaagcgccggtcaacgcagccattactgtttatactgatggcggttcgcgaaataccggaaacgttgccggtcagcacgtgcaccaagatgataaggctgcctgggcttatcggattgaaatgcccgaccaactcgtcactgactctgccggcgaatggggtgccaccaataatcgcatggaaatcatggccttcttacgagctcttgaacaattgcaacagcttggccaaactaagactgggattctgttcgtacttgattcacagtatgtcctcaacgcagtcactaagggctggctggctggttggaaacgacgcggctggaaacgcagcaatggtccgttagttaacgctgagttatggcgtgaagtcgaccggttgcttccagcattcactgcacttaattaccgctggactaagggccacgctaccaatcagggcaatgtctttgtcgatcatttgttgaatcaaactatggatcaaatgcacgctggtcagccggcccaagcctcgactggtgctaaaattagtccacagccagctaaaactagtgtgccacagccggctatgtcgaacccaacaccaactaagtctaatcaatcggccactgtacgctcgacaccagctgaaaaaaagccagttgatcccgaacaagtcgcccgttcagtagcggcgatcaagaagatgctacgcgataactaatcaaaaactgtgaccccaacatactgattgctggaaccgaattccgcaagtcaactgtttggatcacagttttatttcattaaaatttatagccaaccaattttttttagtccattggcgatgccatcgtgatcacaatcggtcgtcgtaatgtctgctaatgctttaatctcagctttcgcgttacccatagcgaccccaataccggcgctctgaatcatctctcggtcattatcattatcaccaaaggccgcaacgttactcgaatcgacattaagtgccgctgccagttttgcaattccttgcgccttagatcccactttgggaatgatatcaaccccgcgttcatgaaaacgaacaaaggaaaactcatctggatgcggcaacaatcgattttggacatccgggtaaaacatcatggcctgatacacatcatggtgctgatagtaatcaggggcataatccaactcaggtgcccgaaacgtgttcaacacctggcgcgtcgtggtggacggatgtgtgtggatatgtagcccatccagtgattcgaccacaatatcaatattctgtttatccgccgccgcaaccaatttgccaacattgtctttagataaggtgtgttgatgaatttgttggcgaccagcaaacgctgctgaaccattgcacagtacataatcttgtaattgtaaggcattaataactggccgggccatcgctaaattgcgacccgtggcgatggctacatgaatcccgtcatctctaagtgcttgaatactttcaatggtgctcggtaataattgcttattgcgagccaatagtgtgtcatcaatgtcaaaaactgctaatcttgctaccatattaattgctcctccaagttatcgcgggataaattctgatttaatcaattcatgggtacgggtcttgccgattgccaatcgaaatgctgactgacccaatgattctagatgatggtcgatcgtcgaaaactttaatagtcgactcgtcagcaagttctcctgcccaatcactggaatgggggctaacccgtgatccataaaatattgataggcgcccgccccaatatcatcgccatttgcaaaaatcgcggccacgcgagacgcttgattggcaaaatacttaccagcgtggtaaccgtcttcataagtggcagcaccggtatagagtcgctcgtcatccaactgaccatatacttcgtggtaggctcgccgcgtaacccgtgtactagcactaatgacgttattacggctcaaaataacgcccatcgtcgcataaccttgttgcttcgcccaccgtaatgccgtaacatatgaagccatgcggtccgtataagctgcggccaatgcccggtcatcacctggatcttcacaacagacgatttgaccatacttgcggtaacgttccagtgtatccagtgaactactacgtgacgtaaaaatcagcgcatcataggctttacttcttaagtcttctaaataatggcgttcaatcgtcatatcataattagtcggtagcaacatgattttataacccgccgcaaagcctgcactgacgataccatcaactacccgtgcgaaatacgggtgattcgcatacggtagtaccacgccaattgtcttcgtccgcccccgacttaaatcacgagcgacccggttaggtacgtaatccagttcttgcataatagcctcaactttggcccgtttatcatccgcaacgtacttctgatggttaattacccgcgagactgtcgagacggaataacccgatagtcgcgcaatatcatgtatattcgtcatcacagaacttcctctctcaattgatgataccacgttgtttcatataattaccataatttatgaaaccggtaccaggtcaagctgattttactcagttttatgataatcgtcgcttttttccaatattaaccgtatgatactaactatggaggtcgatgacatgtcaatattaattgccttgcaacaacagtcagactttactagtactgaacagcggatcagtagctatattctggcacatctagatcaaatgccaactattctgatcaaagacctagccgctaagacgtacacatcccattcagcaatcattaggttggcccaaaaattgaactaccggggctttcgcgatttccaacggaaattgactgccgaaaacattgcccaggcacatcaagccgccactgtggatgccaattttccgttctcggcgacagattcggtcgccacaatcagccaaaagatggccgccttgaatattcgggccattcagacagcccagcagcaacttgatacgaaccaattagcccaagctgctgacttattgacgcgatcaaaacgaatctttatcttctcgcaaggtgactcacaactacgggcccgtagttttcaaaataaactcgtcaaaatcaatcgttttgctataatcgccgaagaatatgctgacgaatcctggaacgcagccaacttaacagctgatgattgtgctctgattatttcatatgctggtactactaaaatccatcagcaagttgccacctattttcacgctcatcaaattcccatgattatcctaacaggtaatccacaatcaccactcatcagtcaagcgacccagcacttgctcaccgttcagagtgaatataattttgccaaaatcggtacttttgcatcccaagcggcgtttgaatacgtcttagacagtcttttcgcagtcatgtatgcacatgattttcatcaccatttacaagacctgcgacaaaaacagcacctaatccaggacggcccgctcaccacaaaataacacatctaacgactcaaaagcgcgtcctacagtttctaggacacgctttttacaatatcttctatttattgtgcagccacgttagcaacgacgcattagcccaattgcaatcccgcgctcgctaacgcttggtcaacaacttccatgaccgcttgggaatgatctaattgccgcttaacggttaccatatcgtgattagcaataagacgttcaaacgccacaaactcagcatacatccgatgctcagcttgattaagcgctaaatcagttgtcgttccatcatgtgaaatttcagtgatactttcgaccgtattagtaggaccgttgacaatgatcgaaccagtcgtcccctgaatcgtggaacgtaccggtgaagtcgaatccttggcaccgatacaaacgactttaacattcggataggtcaacactaagatgcctgatgtatcaatatttcgttcaacattagctaaatactgcacgtgcgttggtgcgcctaacaagccaaccacaaaatgaatattataaatattcaagtccatcagggcgcccccaccaagcttaggattaaaagctggtaagatcgttcgggctttaaactgatcataacgtgatgaatactgcgaatagttgcattcgataattttcaagtcgcccaacttggtcaaatcacgtttgattgcctgatagttttccaaatactgattcgtaattgcttcgattaacactaagtcttggcgacctgccaattcgattagttccgttaactgagatgccactaacgtaaacggcttctcacaaataacgttcttccccgcttgcaatgcccgcttcgcatagtcataatgtaacgaattcggcaaagcgacgtacactgtatcaattgtcgtatcggctagcaaagctgcataatctgtgtagaccgttccaatacgatacgtggcttgcagctcgcgtgctcgcgccacactccgcggcgttgacagcaatcccaccaattcaatcgcgggaatgctcttcaccattggcaagaagtcctgaacaatcttgcctgttcctaaaattcctaatcgcatcataatcctcctcataatttatattaacgaattaataccggccaaatgaaatcagctaaggcccactgaaaaaagctcaagtttgcgtaaacatgcttagccagcgtcggcttgcgccgaccgccaacaattggcaccaacctcctaggacgcacaccggtagccgaacaacaatctaaagctgacacgtaccaatagctgggctagtgcaacactcaagaagcgctaatgtcggcattgttgaataccagtttctaacattttcacttgcaacaacgtttcctcatctttgactaacttaggttgtccattgatgatgctgtcgtaaacgccggcgtaaacccgactgtagtcaccaacttccgaaacgactgcctcttcgtgatactgacccgcatcgtcgatataagttaacgtgccatagttttcaggttgatcaatgccaaagtcagcgtgattcggcatgtaaaaatgtttcagatcgtattcctgacgatccttagtcgcctttacgaacatgccctttttgccataaaccacgaagctcggccgtgatttaatgcggaaatagctagattttacagagactttcaaggcaccgtaatacagatcgatatcaaaataatcattcatccggtcacttcccaatagttgccgaacatcatagtgcacgtcatccggctccccaaagtatgcaatcacttggtctaaagtatggcaagcatgaccatataaataactcgtatctaatgaaaaatggtcaacattggttggaacctctggccggaaataatcaaagtgcatttcgacttccagcaagtcaccgaggacgccgctttcaatgaccttttgtgtcgtcaaatagtccgaatcaaagcgccgattctggtaacactgaataaacaaatgcttttgcttagccaattcaaaaagttcgcgggcttccgctgatgtttccgtaaatggtttttccaccaagacattcttaccatggttcaagacatccttagctaccgaatagtgcgtatgactaggtgttgaaacaactacgagctgaatatcagggtcctcataaatatctgctaacgtagtcgtgtaatgcacgcccgcaattggttgccaattctggtgtcctgaacgtgaatagatggtcttcaccttaatttgatctttgagtttcagtgcaaatggtaagtgatagcggttagcactcttaccgttgccgatataagcaattgttaacatcgcgatgtcctccagttaagttgataatttcattatactgacttagaacgtcacgccaagctaatgacatactttaggtcaaaacgttcaataattaacttctaatcggtctttttttaaacattaggtccagccccaaattaatcattgcagataatacttttattcatatgattgcgttaaaattaaactactttacaaaatctaggaggaaatttggtttgcaaaccgttttcttagtcttattactcgttgcggctgtcgtcgttgctaacgccgtctacgcacgtttcaatcaaattccagtcgcctttttacaaattggggctgggttaatcttgtctctgattccgttgtatcgaaattttgaattggaacctgaaatttttctattcgtcattatttcgattttaatgtttaatgatggccaaaacaccaatattcgcaagctcagtcaccagtttggcacgaccctttcgctttcggtagtgttagccatcgtgaccatcctaattgttggtacggtcactcacttactgattcccgagttttcgctggcacttgcttttgcccttggcgctattattacgccaaccgatgccgtcgcggtctcatcgattacgactaaagttgcgattccaagagcagtcatgacgacgcttgaaaatgaatcactgttcaatgacgcctccggaatcgtggcctttaacttagcgattgctgcgatcgtcactggtaagttttcggtctggcacggaatcactaactttttatatgtctttgccggtggaatcttcgtcggcctaatcatcggttatgtcattgttgctgtcaggattatgctgattcgcatgcgggtcgatacaccttctgtgatcgtcccctacacattactgacaccgtttgtcgtctatttcttagctgaatcgttaggcgtttccggtatcttagctgttgttgccaccggtctcattcatggtgtccagtccgatcaattacggttgaccacttcccggctacaaatcgtgatgacaacgacttggtcaatcgtggctagtattttgaacggtatcgtctttgtgttattaggtgtgtcgttgccaagtgtcatcaaccacttacagcaacgtgatactagttcggtcgcggtattagtcggtctgggaatcttgctctacctaatcatgacgttcgcccgttttctctggacgcgcttcgacttagcccgtattcgcgcgtgggataatcatgaaaagacccgtaatgcattcgtgatgggtctgagcggcgttcacggcacgattacgctggcgatggccttttcattaccactaacactcaatggcagtgcttttccttatcgcaacgatattattttcgttgccgcagtggtcattctaactagtctgctggtgccaacacttttgttaccgttgacgttgccaaaacaagttgttaaggtcactgaagatgaattggcaaccgccaaagctgacatggtaactcacgctattgatctcatgcaagcacgccatggtaataatgctggcactagtaaagtgattgcgattctgtccggccaacgagtactagatggtcgtcctaagcgctcgcaactggcgagcttgttcgacgccactttcaaagttgaacaaaccactattgatgaaatggttgccaacaatgaaatcacgccccatgccgccgaaaagtacatgcgcgtcgctagtcagacgcgtctgcagaatcaacaaactttcttcgaacgcttgaaattatttttccagtttacactcagcaaatggtcgctcagcaaaaaagctcgtgcccgacgtaaaatgttccgacaataccggccccgtggtggccagagtcgaactgagctcatgactcgtaatcggcaaatgtggcaacaaatgcgacagatcgaacaaaagccgtatgaggccgtgttagcttatttagccgacacgattactgctgacaatcagcaagctatcgggatcgttcgccgcgcctatgatgaacgtcatcgccgcctatctggtgaacgggatttccaggaaactcaaaatgagcttctaattgaagcattccagttggaatataacttcattcagacccaattagccaataaaacattcagctcagaacttggtaaccaactctatgaacaaatttcaactgatcagttagtttacttgcaatcgatcaataccgactaaattcgtttagtaatgtcaataacgtgaccaactgtccacaccactatttgggcatcgggtccgttacactaacgttgtaccattggtcgaactgccaactgaacgtctcaacaagccccccaatcttgtgaccatggtaacctaatgacgcctgacaacttgtcggcgtcattttttatgatatttttgaaacaaaacacttgtcttagagtggctctaaggtgctaatctataaaagtattcatgaatgagaaagtgagcgatagataatggaaacaccgattttagcacgcattgatcagccggccgatctgaaacaattatccttgccggaattaacacaactcgcaagcgagttacgtcacgtcctactcaataaagttagtcaaactggtggtcacgttggccctaacttgggcgtagtcgaattaaccattgcctttcacaccatttttaattcaccagttgataaggttgtatgggatgtttcacaccaatcctacacacacaagattctaacgggccgaaagcaagcttggcttgaccccgctcattataatgatgtcagcggctacactgccccagaagaaagcccccacgactatttcaatattggtcatacttcaacctcgattgccttggcaactggcatggctgttgctcgtgaccttgagggcaaaacaggcaatgtcatggcagtgattggtgacggctcattatccggtggtttagcattggaaggtctaaacatcgcggccaccttaaagtctaacctcattattctggttaacgataatggcatggcaattgcagaagaccatggtggcatttaccaaaatctccgtgaactccgcgaaactaacggcacgagttcccataacttgttcaaagattttggcctcgattatcgctacgttgatgatggtaacgaccttgagaccatgctaacgacttttaaggaaattaaggatgttgaccacccaatcgtgttgcacgtccataccgaaaagggtcacggctatcaacccgcgatcactaataaagaagctttccactggcacgtgccgtttgacctagcgaccggtcagacgttgcatcccaacaccaaggaaacgtatacggatgtcattcatgccacgttagccgatgagttagcagccaagacgcctatcacggcaattacggcggctgttccaggaacttatgacctcaaacgctttgctcgccaatatccagaccggtactttgacgtcggcattgccgaacaagaatcgattacatttgctgccggacaggcccaacaaggcttacggccaatcgtcttccattctggtaccttcttgcaacgggcctatgatcaactatcccatgatcttggcatcaataaattgcccgttacgatcatggttgccggtggccgcattaacgcaggcgatccaactcatcaaggtatctttgacgttgccatgctcagtaatattcctaacttaacttacttagcgccaacgaccaaggaagaacttcaagccatgatgcactgggctctccatcaaaataacggtccggttgccatccgggtaccaagtaatgacgtccagtcagtacctctagcgcctgattttgacgcaactaagatgcacacattacacgctggtcagcaagttgctttactcggtgtaggcagtctcctgcctttagcaacagccgtgcaacaacaattagctgagcaacacattgacgcgacgctcattgatccccgggacatttctgaccccgatacgatgactttggccaacttaaaggccgaccatcagttagttgtcacggttgaggaagccagtctcagcggtggttttggtgaaaaagttagtcgctactatgacaacagcgctatgcgcgttctgaactttggtgctgccaaacgctttaatgaccgtgaaacaactaatgaactgcggcatgaatttaagctgacccctgaccaaattgtcacggcaattactgatcaactagcagaataatcatcaggccagcgactcaactttcgtttacccaccaaaagtctagccagtatgttgtcgaactcaacacgctggctagactttttatatttaactgacaataacccaatctcagtttaacgattgggaaaacaggacggcggctactgtgccaatttggggcaaaaatcagcaattagcaaacagaacgccggctaataagtcgccattcgcaattatttatattaacgcccaatacctggcgccttggtcggccacaaaatattattaatattttattgttcagaaaagactttcagcaagctgctgtccttatagctccaaatctcattaatataattatttagtcaatccaacgctagttaaacaattgacagtcccatcagagttgtttacagtaaaaccaatctcaaacctaatattggaggcctttattatggcaagtcaccaagccttactgattattgattatacgaatgattttgtggctgacggcggggcactcacttgtgggcaacccggccaagcgctcgcaccaacgatcgtcaaactcgccaaccaaatggctacggcaagcgactgggtcttactgccaaccgatgtccataccccgcatgatccttaccatcccgaaagcaagttgtttccacctcataatgttcggggtacctggggtcgtgaactctatgggccactcaaagattggtacgctgatcatcaagccgccgataatgtttgggcattcgacaagacgcgttacagttcatttgcgggtactgatttggatttacgtctgcgagaacgccatgttgacaccctgcacttagtcggtgtttgtaccgacatttgtgtccttcacacggctgttgacgcctataatttgggttaccaactcgtcattcatcaggatgccgttgctagttttgacgccgctggtcacgaatgggcgttgcgtcacttcaaaaacagcttaggtgcaaccatcgtttaaaaaatgcgcaataaaaatcactcattcaatacgaatgagtgattttttaggattactaaattaattcaaggttggctcaacccatttttgcaacatcaaggtatttaacacaccttcaactaagataactgccaacatgacgagactaccgacccataaagaatcgatttgtccctggttgactagctgactggagagaaagctgaccatgctaatcaacaaattagctaagcggaaagctacgtaaatgaccaccaccgtgataatcacattgacgaaccgttgccgaaatcgtggtaaaaagcccttggtcgcattcgtaacaaaatggcaaagcgttatcgtgctccaaatcagaatcgtcacaagaactaagactagcaacgttccgagtgcgaactgcacggcactacccgcatcaaactggctaaagaacagcgacgctgatgttaagcctcccatcagttcattccaaccaatccacagagttaagcagaataaaatcacttggaccaaccaaacataaacaatatcaaccaacgaaacgactaaattaatcgtatagcgtcgccaatcgctaattggcaataaccagaacgtccccgcccggaagaatttttcatttgaaactgccaataagataaacccaacgattaaaggtaacgccatccaagcacataaattatagaataatgtggcagctgtgaagtttcctttgatggcagtccacaaactagtgacaatcaccgccaaagcttcgataccaatcaataaactcatttgcttaaagcgtggccaactgagggccttaaatagtgaccaactacttgtcatccgtcacacctcccatatataagctctcataataatcttcaagttccatgccatgttcgtcgcgaatctcatctgcaccctgatgaacaacaattgtttggtccttaacgaccacgatttcatcaagaatcggcgcgatttcagtgaaataatgatcactaatcaataatgtcgcttcggcaggcgtccacttgataatactgttaataatttttttgcggctcatactgtcgatcccactaaacggttcatctaataagtacaaagccactttgcgactcagggtcagcgcaatgattaatttctcgcgggtccccttagacaactcacccaatttttgttgttggttgagttccagaaagtcaaccagctcttgatagcgtttggcgtcaaaatcaggataaacaagttgataaaattgcgcgatttgttgtaatttcataccggcactaaaaccagtcaaatgatccgtgaaacttacctgctgcttacgggctacggcagttgtcgcaccattgatcacaatactgccctgacccttggcactacctgtaattagtcgcatcaaggtcgttttccccgccccattttcacctaataaaccgacaatcttgctgggcgccagggttaattgaacattttgtaaaatcattcgttgattatgtttataacgtaaatccttaatcgtcaatgctgtcatgattgtgctcctctcgttgggcaatgtattgttgcagactcgccacgatttcggcgtcacttaaatttagtgcgtgcaattggtcgtacgctaatgctaattgctcgttcaccagtgtagtcctcaattgcataatatgcgcctgatcttccgttacgaaattccccttacctcgttgggacgtcagagtgccttccgtaatcatctcactgagtgcccgctgaactgtattaacattaaccgtcaagtccaacgcaagctgccggactgcgggcaactttgcccctggtggtaacgttccgtcaatcattttatgataaatatactgtttgatttgataataaatcggaaccttgtcatcaaatttcaatttaacggcctccttagtgttctatttttctattacaatataacacagctgataccaaaagtacaataatgacctaccgttacttgtgatagcggttacatttgtaacttgaatctcaatttaggagcgctatacttaaattaggacgtggactaagttcgccacatcacaggagagggatggtagcatgttaaaaaacgaaaacgccattgcgctaattcgcgccatcgatgtcgcttatagtgaccccgaagtacgcgcaattcccgaattacaacaagccttagctaaggccgcacaagacttagactgtgttgcggaccaccatcaagtcgctagccgcctaaaccagttgctaactacttggggggctcgtcattcacaaggccccgccgtgcttgaccagttatacctgatcacactcaaatatggcgtcgatgtaccttgccaggtcccataccgggcataattatcttaatatcacaaaagctccnnnnnnnnnngaaatgcctggaagtcggcgtaggacgaactaactaagcaaggttacgctaactcgcactttttccagtggtccatagctggctgcttttgtccttgaaagttagcatcctaatatcacgattcatgacaaatcagtgctaattcaagcaagctaacattactgcacgtattgttccaagaatgcggcgacgtgacgcttgtaacgttggtaattctgagtaatggccgtggtgtggccggctcccttcaccaaccataaagacttgggttggtgagcattgcggtacagcgtcttgcccatgctagtcgggacaaaatcatcccgggtgccgctgataataatgataggcaagtggtttttacgaatctgagcgattgcatccgcctctttgaagctataaccagcacgtaatttagtaatgagactggttacgttgactaacggaaacgcgggtaaatgatagagttgccccgcttgataactaataatcgcatcagcactcgtaaacggactatcgacgacgtacgctttgatctgtggcaactgccgttcaccactggccatcgtcatcccggctgcacccatactgataccgctcatcacgatttgagttgtggccgttttatgtacgatggttttggcccactgcaagtcgtcgcggcgctccagccagccgtagccgaccgcttttccctgactcgcaccacttgctcgggaatcaggaaccagcacgttgtagccgagttcatgatacatccccgcccacgcacccatcaaacccttattcccagcaaatccgtgtgccaaaacaacagtcctcttagaatttttaactggaatataccaagcaaccaaccgtaaatgatccgatgactcaatagtccaagtttgcttacgcgcatgtaaataccaatacttttggtgataaaccgaactttttttcgatagctttgtactctgcgtaacaaatgacttatcaccacgggcaattgccacgtggtaaaaataactgccagcaccaatcacagctaccgctaccagaacaacgagtacccccagtgtgatccaccatttcttcattaaaattcactccttgatgagacaaaaatctgttttgagcgggaaaatttcgccactacttcataataaccgttataattaaagataactagaccagattgaggaggcttctttttatgcactattccgaaacgtgggatttggacagtatctttgctggtggcattgattccccagcactaactgcaaaaatgtccacgattaaacagcagttgaccacgacagcagacaccttagttcactggcgtgctgccgctgacacaccagacgccgactggtttacccaactcgtcaacagtctgcaagccattcaagccggtattgaccaagctaccgttttcgtggttgcttatcaatccgcacatgcggacgacaccaaagccgccccactattgaaccaaatttatcaacttgataatcagttaaacaatttattaacccgcttcaagaagcagctcgttaagttagatcaagccacctttgacacgctcgtgcaacaaccggcactacaagccatcgcctttaacttaaccgaaatgcgtcagcaaggcttagcgctcctagatgacgacactgaagccctaatcaatgacttagcactcgacggttttcagggttggagtgaccactacgacacgttagttagccaaattcaagtgccctataccgatgaaaacggaataacccagcaactatccgcgggtcaagctcaaaacatgttagcagccgccatgccgaacgctcaacgcgccgaattaatgcgcaactgggagcacgcttggcaaactcacgccgctccctttgctgatacgttgaaccacttggcgggcttccgacttgccaattatcgtgcgcatggtacgacgaacttcctacaaaaaccactagaactcaaccgcatgagtcaagcgacactagacacaatgtaccaagttgtcgctgacagcaaggacattttactaagttacctgaagcgtaaggcccagttactcggtaaagatcaactagattggcaagatattgaagccccactaaccttgggacaacttcctaaccaaacttacgatcaagctgccgattttgtcattaacaactttcgccaatttagtccaaagatgggcgctttagcccaacacgcccttgaacatcgttgggtcgaagctgagaatcgccctaataagcggcctggtggctatatggaaaatctaccagagacccacgaatcccgaattttcatgacgtttacgggttcacctaatgacacagccaccctcgcccacgaattagggcacgcctttcatggcagcgtcattcaagatctgccactttggcgtcaagattacgcgatgaacgtggccgaaaccgcctcaacattcgccgaactgattgtcgctgacgccagtgtcaaagcggccgatgatgccaaaaccaaattaactttattggatgctaaaatgcaaaatccgttagccatgtttctggatattcgagcccgcttcctgtttgagacgcgcttctatgccgcccgtcagcacgggatcgtcactcctgatactttgtcagacttgatgctaaccgcccaaaaagacgcctatggtaatgccttaaatacttaccacccgatgttttgggctagcaagttgcacttttacattgacgacgtcccgttttataactttccatacacatttggctaccttttcagtctcggtatctatgctcaagctaaaacacaatcggactttgaagaccgctacattgccctattgcgagacaccgccaacatgtcgaccgaagccctagctgccaaacacctcggtgttgatctgaccaaaccagccttctggcaagctggtgtagctttgatcaagcgggacatcgatgaattcatggcgttatccgcaccgttaatctaaggaatggaagtgagcacatgtttccagaacgtttaagagcactacgtcgggggcaaaaaatgaccctcgctcaactcgcggcggccctcaatcaaatgccgaccgcagacaagacgactcgtcaaaataccgcggctcaaatcggtaactgggagcgggacttacggaccccgtcctacctagaagttcgtaaattagccgaatttttcaacgtcacgaccgattacttgtcaggtaaatcagaccaagaagagtatgacctcggtcgcatctttttatcgggcaagccgttgacgtttaatcaagaacaattatccagtgaagaccgctatgaactgtttcagttgatggatggttacttacatggtcgccagcatcgagtttcaacggatgcgaccggccaagaagaattagacttacactttgatgactaggagttttttatgaatcccaagaagttaaaacaattaaaaaagcgggtcaaaaagcaagccggtgccccgtatattcaacagttaatgaagtaccgcgacttatttaaggatgatccccaaattctagtgctgatcaataatgtcttggaaagtgaccgcttgctggcagccggcttagctccccaacaattgccagtcttagaaatccctgatgattttcaggaccatctctttgagcgcatcaatcagcaatatgccatgggtgatcctgctggtgatgcggcttggaaccaactatcagccgctctcccaaaagttgaccaacttctacgcaactttcgagactatatcgaagatcagtatgggatgtgggcctacatcagtgcgccatttctgaaagacctagctgacttcaccggcagcgcaccagttctggaagtcatggccggtaacggctatatttccaagggcctcaaacgtctccatcctggtcagccaatttataccacggattcaaaggattggacacacgaaactggcaatcagacaggacgccacccagtcacgacgattgaagcgttggatgccgtcagtgccttcaataagtacgccgcaactattaaatacgtcattatggcctggtcaccggacaaattgactattgattgggacttgttacaagctatgcggcaaagtccttacgatatcccattgatcgtcattggcgaaaaatacggcgccacgggttccaaacaattttgggaccacgctaattatcaggataacgaggccgttaccaagttaaatgctcatttccgaccattcgacctgattcacgaccacgtctatgtggtccgataattgaacacgcgttaaattaaagtcgtgctttcaggattaaattctgagagcacgacttttaatttttccgtcatagctgaatctcttttttgccaaattcattcgtgatttgcttaaatcttagcatcacattttcaattgttgcagttgttccaatcccgccaccaacgatgttcgtgaaattcccccggcagcgagactttggtcgtcaaattgattaagcgtcgcataaagccaaattccgagctgcaagaattcagcttccgtcattgcgaactgcaacgctaacaaccgctgagcggcttgagcataagcccttctgtcaattagttgtgccaattcgacttgatgtggcaacggctgatcttgatcttgcggaaacaccacctcagttgtgcctcccttatgacgactaagcgtgtaccctaaccccgttgcgaacgcatgtaactgccgcattaaccaatcactttcatcttgcattagcattaatccccctaattgtgtgccatccaataaatcgctaaaattgtcaaaatgactgataacgtacacatataccagtaaaattgtttttccggtactgttcgaccatgatttccctgataggcatccgccatactagtgataaacgtcgccaaaattgtatataagatcaataacgtaaacgcgtaggccgtccaagccgtccccatcggttggtgtattgcttgcaagccccagccaatcaaccatcccaccaataaaagacccgtaggcgctgcaattaaccgtcgcttcatcctcatcactccccctagaattagcttcattatccgcttttaaaactcccagaccaagcagaatgacgccctaaaattatatccgcataataccaagccttttctgcacgaaatattgttaaaaggttccggtttaagatcaaaagtaaccagctaggcccgctggaaaaagttcgaatcagcgtaaacatgcttggttaaacgcgtcctacgccgacttccannnnnnnnnncaccggctgacgaacaggaatcgagttaaccggaaccttttaacaatcattcctgacctatcctagaacgaaaaagcctgcaatcaattgattgcaggctcgttcacactgactattcgacgttgaactccttgaaataactggttagtggtttcaattcgttcgcgtcatatttttctttgaaggcactgacagaagcatccgatgtcttggctggatcaacatcaaggatttcaactggtaacccccgtttgtccgtaatcttggcatcaattaggaccggacgaccagcctttaattcggtcatcgcagtttcgaaggctgcgtgcagttgatcaaaatgttcaacacggatacctttgacgcccattccttcagctatcttagcaaaatcagcatcaatcaagtcgataccatagtatggttgcggcacatcttcttgttctgatttaataaagttcaacgtttggttagacgtgacaatattaaagattggcaagtgatacttaacttcggtcaataagtcttgcatgaccattgagaaggccccgtcgccagcaatgttgaaggcttgccgatcaggataactcatcttcgccgcaatcgcaccgggaacaccggcacccatcgtggcaaatagtgctgaagtcaataatttttgcttgggattcatctttaggaaacggaaactattaatcgtattgtcgccaacatccattgagaaaactgcatcatcggcagcgacccggttgatttcttggtagacttgttcgtattcaagtggatcggtcgtccgttcactcagcttcttcaaatactgtttccagtcagccatatctgctttagccgcttggtagtatggcgacggtgacgctggttcacttaatgccaaggcccgtttgatgaagactttagcatcgccattaaccccgaaatccaaatgatggtgccgaccaaacttgccaggatccagttcaatttgcacatatttgaagtcgtgagtcgtgtacataatctgtgcgaacgaataatctgcgccaactgaaacgaccaaatcggtaatccccatcagttcatccgccgctttcgaggctgcccgataagcgcttcccatattaccatcaaaactatcaggaatgacgcccttggctaacccagtgataataatcggtacttgcagacgctccgctaacgccatcatgtcctcggttgcaccacgcgtcccttgaccaacgtggaagacggggtacttggcgttcttgatcatcgttaataccgtcttaacttgttcatcatcaatagtaggaatgccggtcagtttagcagggacacttgctgaatcgtaattaagatcaggaatttcaacatatccaaaatcattaggaattgtcaccaccgcaaccccattttcacgataagccgtccgaatggccttatcgacgacgtatggtaagctttctggtgtcatgacggttcgattaaagaccgccacatcactaaaaatcggttcttcagcgaattcttggaaataatcatagttcatattagtgtgagcaacttgacccaccaaggcaagtacgggcacgtgatcttccttagcatcatacaacccgttgagtaaattaacggcaccaggaccggccgacccaaaggcgaccccgattttacccgtcaactttgcatccgctgccgcagcgagggcccccacttgttcgtgacgtacctgcacatattggagccgttcttgctcaacatccaacgcgtgcatggttgagttaaacgatccaccagcatagccgtaaatctgtttaacatcccaagcttcaataacttttaacattgcaacagacgcttcaatcatctttgccatagtaaatgccttctttttaaaattattgtatacgttttcatttacggttatcagaatacatctaaattgttcaaaattcaattgcaaacaatcattattttataaatattttcttaactaaccaaattcgatgacctgacactggcccgaaatcgtgttagcctgccgttgttctggaaaatatcgaacacttatccatcggcttaatctaaccaatcagcaaggtgaaataatgatgaaagataaagcaattaatattctgactgccgaactgtcagcactccccgttttaataatgacgtactatgcgcttaccgcgaaaccgaccggacagtggcagctgacctttagtctccccgtttattggctgatcagttccgacctgttggcctaccctggctcctcacccggattccccgcttgcgccacaacccccttaaaatgaattcactggctctaaaggcaagctcaagatacaactgccggctcaacgaacgggtcgcgcgctgggatgatgagatgaatctcgcgattttcttactggaacgcggctgtctaatgttactgtcagaaccactacttttaggcgatttaggctatcatagtgtccgacggttatggtattaatggcaataaaaagcacccatgctgttcagttttatgaacagtgtgggtgctgtgtgcattatttaagaatgttggtctccaagaaggcgacagcagcttcttgaatcttgtgaggtacatggtgaacgccaccttcagcgcgtttaaagacagttgccttcagggctggctcatctttaaaacggtgcttaaaatcacgaatatactgataaggtaccatttgatcggccgtaccgttgaaaaagaacattggtcgtcctgccagtgcttcggggtgttcagataagtcaaacttcgccaattgttgataagtttgttcaattagttctgctgggagcttagcttgtaatgccgctggtaattgtgcaacttgatcggttgcaaaggccaccggttctggtgaaccaattaacgagacaccagcaactaccgtgggctgcgttgccataataccggcagcggtaataccgcccatcgaagttcccatgacaccgattttattagcatcactaattccagcagccactaaggccgcgactaattgtggaaattccgcaactgaatgtccaacaatcgaccaaaaatgttcaggatgccgatcgagatcagtcccatcatttcgactgccatgtaaatacgctgtcgggagaatgactcgaaaacccgcgcgtactaactgataagccgtacccagttcagtcgctgtctgatttgtccaaccatgataatcgatgatcgttggtaatttagtttgtgcttgactagctgcaaacacgtgtaatacgggcaaatcaccaaatttggtcgtccgcaccaccacatcttcaaataaatttgttgtcatgtttatcaccgtttccaaaattaatagttaatagtgtagcagaagcccaaacgaaaaccaacccaaacgcgtccatcgtggttaaagcttaaccatcatggacgcactcgagttggctcgttttaacacggttagttatcagctaacgtcatgcctttcaaaactacttttcaagtgtatctaagaaatcttcaacttgcttttgggtcttacggaatttgtcaacatatcgaccaatttcttgaccatcttcgatcccaacgaaactaggaatccccatcacacccatgtcttgggcaatttcaatgttggcgtcacgatcaaccgtgatccagtcatattgatcgtacttcgcttcgatttggggcattactggtttaataaaagcgcaatccgggcaccagtccgccgtaaagaataacatgtgtttacccgtcttgatacgttcgcgaatttcttcgtcgcttaaagttgcagttgccatgaaaaatgcctccaatatctttataataattatagtttaccacatactaaaagtaagtaaagtcttttgctttattttgttgctcggatcagcgcttgcttgagatccgctgctaaatcggcactattttcgatcccaacggatagccgcaataagttagcggtgatcccctttgattgtcgttgctcttccgttaaatctgcgtgtgtctgaactgccggaactgttaacaggctctcgacaccgccaagactttccgcaaacgagattacgttcaatgctcgtaaaaaggtatcgacgtcggtacccgtagcgagataaaaactaatcattccaccacgtcctggatataagacacgttcaacgtgttcatctgcctcaaggaccgtaacgagttcctgcgcattagcctcctgctgatgcaaacgtaatggcaaagtcttcaagctccgtaagagcagccaagcgtcgaacgggtcaaggaccgcaccagtcgtcaccagattaaattcaagcgcatcagcatccgcctgcgacttgactaccactgcaccggctaaaacatcattatgaccggctaaatacttagttgcggaatgaacgacgatgtctgcgcctagatccagtggcttttgaatcaacggtgtatagaaagtattatcaacgattaacttgaggtcatgggcgtgtgtggtagccgctgtggccgtaatatctatgaccttcatggttggattcgatggcgtttccaaccacagggcaacggtttgatcgtctgccagtgctgccaatgtcgcttgatcctgcccatcccagacagcaaaatccaaatgataatggtcgtgtaagaggtcaaagaagcggtacgaacccccgtataagtcatcagacacaataattttgtcaccactattgaaaagcgtgaaaacgagctggattgccgccatgccagaagtcagcgcatacgcagcgatgccgtgttccatctctgccagcactcgttccaaaatacagcgggtcggttgggcctcgcgcgggtagtcaaatcccgtagattgtcctaaaccagcatgtcgatatgctgtcgacaagtagatgggcgccgaaattgccccggtcttctcatcatcactccgattaccagcttgtgctaaccgcgtttcaatgtgtaatttctcagcttgttttgtcataatctcaatcccatccaatctagttatggtcgggcagtctacagagacgccagtgtaaaaatgactacaaaaaaagccgccatcttcaagggacgccggtcgcgtgttaccacccaagttcaattacgggtcaccccgttaaactcatcaagtcattattgactcactggagtatcggccagtcccgccagtacagccttgcgaccgcaactgggcattccgagttcatcttcatcaggcgctaccttaccgctttacactccccacggctccctgtcaaaggtataacctgactactcttctcatcaacatgttatttaatgatattttcatcttactctcataataataggagcgcaagccccaatcttatttcagcacaataaaaaatggtgccagcattatcctgaccaccatttttacagaaacgcattcgacactgcctagctatcccaataatttcaagacaatcacaaaatatcctaaaatcaaaatactcaaccccagcgtcttcaagagggctaaccactggccccctgcagttcgacctttagggcccagacaaatcgcaacgccgccacaaatcacggccaaggttcctagctcacggccccagtttgcattcaataagtaaatgaacggtcccactaagccgctgacaatcgcgacgatccccagtattttcagaatcaagcggcccagtcgcttatcctgttcgtcataaatttcatgtttctcttttgccatcaaaccagccaccaatctttatgaactactttcagtatgccgtatttggtcacaatgagcaagaaggcggttacaatatcctggtcaaattactgaggcatcactaggctagcttgtcataccttaccttgggccctgccggcacttacccgtgataacagctgaatcaagctaccaaattgaccatgatgatactaaaaattaggtgttcaaaattgacacccgctgaacacccaattggcaacaactatttttcaattgtaacctgctaaacgacgccattatggctgtgttgcaacaacttgccatacgttccccttagccaactgctgttgttccaattgaccttgggcgttaatccgaaaacgacccgctaagtgtgcgacatcggcgttggtattttcataaacttccacgtaaactaaaccaccgctttgatactgattaaacacaaagttttgcttattggcggttgtttgttgatagtccttagccacttgttgccaagcccaatcattaatctgactagctgttaactgctgtggattggtcgtctgctggccgctagttgatgatgaggtcgcggatgcagactgcccggtagttgtttgactagttgcagtggtatttgaatgtccctgcgagctagctgcagtagctgtcttactaccctgactagtcgttgcactagcttcggattgtgactcattaactgaagttgtggaaactgacgatgctttagttgacgacgatttagcagctgtcgattgcttcgtcgactttgctgaagatgacgcgtcttttttagccttagtctttgacacaactgattgtgtttcactaacccgcgactgactagactgatggtcggcttctaagtaataaccgcctcccagcgcaatgatcccagcaatcacggctgaactaactaacatttttttcaagataatcaactccccaaagattaattgtctgatgctaactacagcatacgctatgttgtctcactttaccaacgtttacctgttctggatcgaaatttaactttaaattatatttggctcagttggtccatttttgggcacctaagattcattgtgccatccttttcttgactacgtatctcctcaacaacaaccgtggcatcagcagaaatgaattttgttaacttgaaagctgtttccacaaccttatttctttaaagttcattttgccatcatactgccccttataagtatatcgtaaatgacacccgactacggcccaaagcgggctaacaatgtaaccgtttcataatttgtcatcaaattgttacttatgtgaggcccccttcgcatgctatagtaatcaaccgatacaaaaaaactaggagtgtgtgaatagaatgccacgtaatttaaaagaagaagttgtctttaccgccattatggccggtttaatggtctttgtgatgaccgcctataacgttacccttgctcaaggtttcagcaacgggttagtaatggcaatccttagtggctacccactcggtttattcgttgccatcattttagacttattggtcgtgggaccaattgccaaacgattagctttcaaatatatcattaatgattacatgcgcaaacgggttgtcttgattgggattaccatctccgtcttgatggttcttggcatggtaacttgcatgtccctcttcgggattgcagtggaaggtgaattgtccggaagtcacgttttagcgacttacggtcacacttggatctttaacttgattgttgcattaccactccaactcatcatcgtcggcccaatcgcccgcggtgtgcttggaaaaatgcaacgggcaactgctaacaccgagtcagcagctgcaatgaacgaagaggactaatctttcagtccattgacggacggtcgccgggataatcttatcctgatggccgtccgttttattttacgactatccagtcgaccaccgcttttgccgaatagtccaccctatgaaagtcttatgcgtgatctgtacgcaaaaaaaaacgcgtgtcagccatccgaaaatggttaacacgcgttcatcgcggcactggtaaaaccagcgggagtgacactccacaatgtcagtgacccagacactctgaaatacgtcagagaaacgtgccccgctatcaatattagtcactagccgctcgcgcggaaccgttattgctaacgatctgactctatcgactcatcgcatggactaccatatcatcttcattgataaaatgcaagtcgcaccgccacaaaattcgtggctcctactcaccacagttgggccgcagtacttaacttttcgcaaccaaaaaaattgagtatcccgttcgatttaatgaacgacacactcaattccattggtattttgattttggcttggctccaatatcaattcttaccttaccatagtcatgtaaagatttagtaattaactcgtaaagattacgtttaagcttccgccgccgtgatctgatctaagcgatcagtctgagccgtcagccaatcggttaataacttttcagcgttggcttgatcagcgagcacgtcggcaacgcttcccagctcatcaattcgcaatcctgacggtaacgcatcggattctgcaatcatgtaaacgttgattggcagcgtatcctctgccgccgtaacctttccaatttcggtcagattagccagtggcaaattaataacactcgtctccaaccgaaagctgatagctggctcatgcttagccgtcagcgtcacttgggcaagctggtcggcattgagtgccgctaccagcttcgccagccaaggcttaaccttggtcgctagtttggcataggtaccagtcaagctatcccgcgtaaccttgtcagccgtaacatcatcaataaaagcttgtacgtttcgttgcataaaacattatccctcattcattattcaatttcgttaatttgcacgtcgccagcgagtcagtaacaccaacgtataaaagttgattcccaatccaatcacacccataacttctaacgccagtttaatttccatgccagccgtactctgatagcccgacattaaggcgctgacaagtcctaagctatatatcagtacaactaaccctaggacgtaaaaacccagcatacgattaatatacactgctagaacgcctagaaaatataagactagggcaatcagcaacccctgccacatttccgctaccgaaatattttttgcctgcaggtgaaaatggctagtcgacatcatccaattgacgataccgtaacaaaaaaaggacacaaacgcaaatgcaactaagcgagtcagtttcaacaaatcactcctattattgggcaattaagtcaataacggctgaccgttcaattcccgtgaagtactgatttaaatcaatatctgccagcgctttagcgatggcctcatggtcgtaccgcacacctttaagggcggcttcaatatcttgaacgttgccactaccaaagaaatcaccataaaatttaatgttattgatcaagccgtcatcaaccgagatccgcgcatcaatggttcccatatcaaagtgttgacgccgcttaaccgagaattccggtgatttaccgtaaacccaatcccaattagcataatagtcttcgtaaattttatcaatagctttttgttgttcaggtgtcacgtgatattccttatccgcaatctgatccaacgaatcaacatggaacaactcttttaacagggcatcctgaaattctggcaccgtgatattctgatattctggcgctaaataaggccgtaaattcgtgacccgactccgaacggacttaatacctttggaagcaatcttgtcggtcgggactgttagcgcctgtgggacaacgtttaaatcaacattcaacatcagagtgccatgggagaacgtcttgccattccgtgaatacatggcgttaccggagaatttcttaccatcaacgagcaaatcattgcgaccactgaccgtcgctgtcgtcgcccccatatcgtgaagcgcatcaatgattggcttggtaaatgtcttaaagtcgccaaactcttgactgtcactatccaccacaaagctgaagcagaggttaccaagatcttgatacacagccccaccaccagagagacgccgcgttacggtaatgtgatgttcccggacatagtcggcattaatttcttcaagggtgttctggttccgaccaacaatgatgcacggttcttcatagtagaacaaaactaatggttcatcgaaatccacgttattcattaaatattgttcggttgccaagttacggccaatctcatgatctttcattgcgacataatacatgttttaaaatctccttcagctttaggttactttaatcatacagcaagatgaaaaaaggacccacaatgtgagcccattttttggaagaatcatacaaaaagtttggcgtggcattcttcacaccacaagatgactgattcactatccacatccgtgaacgtttgattggcggcaatccgttctccgtggacataaccgtgccatcaatagatggaggttgggccagtcagttatccgaaattagcggaaacgctgctatactgcactagctatcacttgacgggtttgttacaacaattgggtaacagtttgatactgacctgtgactcttccgataaatccaatatagcatacaatgtaagcgattgcaaaccgagtaaaaaaacaacctagtcagccgaagccaactaggttgccgaaacattaatagcggtcgtaatcgctattccatttcaatacccttagtataaagccatttggacgccggaacaactaatatgcctagccttcaagcttagcaacatagtgcgttgcaccggagcgactcagatatcggagccacgtgtaaccctcagcttgaaccgtcccattgtaataaaccgtttcacctgggttatattcaccgacaacgcttgcgcgcgtacttggcgccgtacgaatattagtcgtcgttacgaagcggaacgccccttgactgtttgttaccggcttagacgtcgtatttccggtagcggcattaccactaatcgctacgtaatgttgggcgcccgaataagacaaataccgtaaccaagtctggccgttagccgttaccttagcgttgtagtagactgtatcaccagcactataggtaccgacacttggggcatttccggccggtgtattcttaatcgccgttgtttgcgtaaagcgataactaccactttgaggcgttacttgcggtttatcaacattggtcgacgtactctcaccactaatttgcacataatgctgggcacctgagtaagacatgtaacgtaaccaagtctgaccatttgtcgtcaccttaccattgtaatagaccgtatcgccagcattataagacccaaccgttgtcgcactagttgcaggtgaactcttgattgctgtcgttttcgtgaaacgatacgacccactggttgcaaccacgtccggtttagccacagcaccaacctcatcaccactcatagccacgtaatgctgagcgcctgaataggataaataccgtaaccaagttgtcccacccgtggtaatcttgccattatagtaaaccgtctcaccagcattataagtgccgaccacttgagccgttttgcttgcggctgatcgaatgttggtctttgcggtaaacttatacgacccactagctggcgtaactgtcgcctggttattattatcattagttgttgtttgactaatcatcacataccgtgatacgccagaataggactgatagcgtaaccaagttgcattaccgaccgttaacttaccattgtaattgactgtttcaccagcgttgtaagtacccactacggcactcgtggcgtccggcgcattgtgaattgtcgttgtcttagtaaacttatgtgtaccactggttggggtgacgtcttgatcaggctgaacttggttattatcatttccgccacttgcctgaccactgagcgcttcttgatcccactcgtgtagcttgttatattcaatgatgctgatcagcgaactcgcgtacgttggcgcggttgcgtagccgtcttgttgcaagagactggcaacgcgccgataatcggtaaccccaattaaattgctgtaacgcggattgacaaccaaaaaggcgccatggtcttcaacactagctgaccaattcgggtacttccgaaaagcgtcttgaatcgtaatgtattgtgagccattccattcctgggttgggaagtagattgattgcccttgataacttcccttgataccgaataagttgtttccctgagttgcaagttgtgattgtccccaaccactttccagaattgcctgtgcggccgtgactgatggcaagacttgatacttgttccaaccagagattgcccccgctttaatctgactcaggaagatttcctgactagtcattgcccgcgtggaccgtgccatcatcgctgatgactggaccgcatcagccgccacagccgtctcaatctttggtgagattttcgcggctaccgcctgctcagtcgcttgcttaggtgcggctgacgatgcggctgatttggctacttcactcgtcacagtcgcgctggattggtccgtagtgacatgactatcctgacttgcggccgcgctggctttagccgtctcattagtcgtactgtgactggcttggctcgtggctgcactagctttggccgttttatcaagttgatcaacagcactagttgtggagtccgccgtagcactagcagccgcgttatccttggtagcttcactggcggaggactggctttgcggtcctgtactgtcagctttagcggcttgactggctgcccgcactgtgacacgacttgtcgcactggtagtagccgtcgtcgtgctggtcgattcagcttgatcgtcagtcttggcaccgtcactggcaactgattggtcagtcgcaccggccgctgtcgtttccgtctgactgccagcacttaaggtcacttgttggcttgcagctgaagcagcgctgtttcccttagtcgcagctgccggtttttgatttgcacttgccgtatcagctttaccactcaacatcggcaacaaagcggtacttagcaataatgaagttactactttttttgtcattccaattttcaattttaaaatccccaaactttccgtgagttagctgttagcacaaccgatttaattcccctgtagcacctgctattacagaataatattagcatgtcgaagagggacattcaaacgagatcgcttcgaattattttattaatatcaattgattgacaccgttatcattttaactgattgatcagttaacaatttgttatcgttgaccgaattgacaatcgctgcaagacgttatgaccaggggcttttccaaaatcaactcgcttctcaattactgtatttaaattaaatgtgactgattgatcgattaacgaccttgaagaatattatttttcaaggactagtaccgactgaaaaaaattagtcatttttcagtccattaaaataattatccttacaaactcaagttatcaaataaatcaatcgattttaaatgcttacattgctgaaaattaatgctaaaatatagttattaactagccatatcaaacgggggtaaccattatgttacaacaatatcaaaatatcctggtaccagttgatggctccaaggctaccgacgaagttcttcggcggggcatcgaagtcgctaagcgtaacaagacccatctcgacattttaaacgtgttggaagtcaaccaatttagtgacacgtacggcggtgcggtcagtggtgatgtcatctacaagttgtcggaagacgttcaaaagcgcttggaagaactcaagcaacaaacgattgacgctggggtgaccgacgttgatgtccatgttcgttttggtaatcccaaaacggttatcgcgcgtgaatttcctgcagaccaccataatgaattaattatgattggctcaaccggcttatccgccgttgaacgtttgatggtcggctccgtaaccacctacgtcagtcgcaacgcaatttgtgacgttttgatcgttaagccggccgctaaaaaagaagactaacaaaaaagtctggatacgttccagacttttttagtggtttccgtgcgttgcccgtcttcttccccgttataaaggagctttattcatgacctggacttatcaactcactatcccgtctagtttgaatcaacagtcgattcgggcttgccttcggacttggctgattccaaagcggattcagggccagttacgccaaacgcggcggattcagctgaacggtgcaccaacgtcgattgcacaactcgtcaatactggtgattgcctgacgctgacgtttatccccagtgactttcggactccgacctcgaactatattgcggctgccacggccccagccacgattttatatcaaaacagcgatctgttagtcgttgataaacccgctggcgtgaaatcgcatcctaatcaaccaggtgaaaccggatcaattttaaatgacctagcagccacactccaaccaactcagcaggtgccatacatggttcaccggctcgaccagatgacttctggtgcgatgctagtcgcattgaacccggtcgtcgtcccgattctagaccgcttaatcagtgacaagcaaattcgccggacttattatgcctgggtacgtggtcactttgccacgccaactgggcatttcaccgcgccaatcggtcatgatgctaccgacaaacgcaaacgctgggtcaacacggccgatgcccagccagcactcaccgactacgaagtatgtgcaacaaccgcccatcagagtttagttaaactgaccctgcatactggccgtacccatcagctacgggtccacttggccgctagtgaccacccgattatcggtgatccactttacgactcgcaagcggagtcggcgcctcggctgatgttacatgcccaattgttggatctacaacttccatttagcaccacacgggtgacggtaccggccccattgccaagtttatttgagaagccgcgtttaatcgagaactactgattgcttgaatctgtttcaagcatagcgaaacctctaaaattagtgctaagacgcttaatggattaaggaggattcccatgttaaccgagataggcaaaatcattcggcaacgccgacagcaacacggcatcaccatcgagcaattggccgaacaatccaatgtttcaatctctctaatttctcgactcgaacgtggtaaggtcgataacattaaactacaaagtttgaccgcaatcgctgaaactctgaatttaaaaatagcggacttctttcgcgacgagcttctccaatcacctaatgttgttgcattactcgactacctgagtgatctgccagcccatcaacgtgaagaacttgccggtacgttactcaaactactccgactatccaaatcgtgagcatttgcgcaacgcactccggacagttagttcaccattgaaccccgtgattcatctacactaaaaaatgattcaccttcctctgacaagaaggcgaatcatttttaatttatcaagcttgttaacggtcggctaagcgcccttaaagccagcatacagttcttaatggtgcgttgtcactagtaacccactcatcactgccaatatgatacccaccgccatggctttgagtggttcacgaacgatgggggtggcggtcaaagcctcgaccatcgccccacctaaatacgttacaacgagccccaatacggcgccccaaaagattgtgactagtaaactagccagccacgttgtcttcaatagcaagctcctccaatgcggtcaggcacggctgaccttttgattgagtgtatcaaagttgtcacgcgtttgcaaatttattaatagaattcataacttttatataatagttctatccaaagaaaatccccaccatcaatgacaaaaaagctcagcaccgaccattcaggtcctaagtactgagcgattatcatgaccgctatgacaggctaatgtcccccactactcaaatccgcaggccaatttgattcgacgaccgtttgcggaacatattggcgattcaatagtgccagccactgccggacaatcttgctcaaggtaaagtcatgactgcgttgccgagcgcgcacggcatattcagcgcgacagtcaaaatcagttaacagtggcattaagccagtaatcagagcattaacatcgcgggccggagtcaacacaccgtactggccaccctgcaagtactcggctgagccagtattccacattgagacgatcggtaaccccatcgtcatcgcttcccccataactaatggcatcccttcccaacgcgaagtcatcatgaagacactcgcctgttgataatgcgcccgtaactcagtatctttcagcgcaccccgataaataatgcggtcacgaacatcgagttcagccatcaaccgattgaacgtcgctaattggtcttcgggaccagtccccgcgactgcaatttgccaatcagcaggcaaggctcgcgcaactgtcaacaaataatcgagccccttatgttgcaggtcaatacgaccagtgtaggcaatgatatgttgcgccaagtcggcctgctgaccatgagcttgcatggtcggtggattatagaacttgaccgtatgggcgttaaaacgtgagtagccttcccaatcataatcggtcaatgtcacgaccgtatcagccgctaagagccctgcgaccagttcatcttgcatttggacgtaatactgattgaggtagatatcaacattattgtgcatccacgcaatgacattgacccgtggaaaacgctgtttgattgccggagcaaaactcgtcagtaaacctcccgggagaataacggcatcgtaagctcccgacccaatcgtcgtgagtaaatcatctatttgaggcgcataaacggtcaacggatcagcgccaaagtaattaagtaccgtcgcacttgcaggccggcgcgccgtgataagcggtgcgctcagttcatagaaagaccggggttgggccaaggagtaaaaggcaacttcggcttgcgaggtcaacgcattgccgaggaccgtcgccgctcgtttgacaccatccatcactaaattctcgactgttatcaaaattttcattagcatcgttgactggcgattaaacaaccagtcgctcctttccacataaactcggttcatggaaccggaatcgacgatgttaggctgagctgattgcgtcagacccgttcatccttaactaatcaccatcactagtatcagcttaggtagcgttattataacaggaataattaaaaaccaattaaaatatgctcacaattcacattatgctagtcattgcaagttgcttcttgattaaacgtcagttagctaggttctgattaagacgtcataggctacattccagcaccaatcagcacttgttgacataccactagtattgcttgatatacacgcaatctgaaataagtcgcccatgctgagttgacagtatccaatcgacacaattaatagcgcacaaaaatagcgttgctactggaggcacaggccagtagcaacgctattttcaaattaagattttaactgcttattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctatcttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcgcgaatgtattctggtttcttttcggccaaatgagttaatgcacctggatcttggtgggtataaccattatggtcttgttggaatacagttgaagccgcgataatgttaagtgatgggtattttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataagcggttagacatggtttcatcaggtccgaacaaccggaagttatcaggattcttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgtcgcatcgtcattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttgggttagaaatcttaaaaccatttaagttcaagattggtaaaacagccccgtcgttgattgggttaatgaacttcgttgattgccatgaagttgctaatggacccgtttcggattccccatcaccaacaacaaccgcggcgatctcgtcaggattgtcaagaattgccccaaccccgtgtgaaattgagtaaccaagttcgccaccttcatggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatttcaaaaacactccttaatttgcttttcacttgaacgctaactgtttaaatgttttcgtttacaagttctattttaacaactcatttcaaaaaatcaacctttttgttaattggaacggtccaattttataaattaaaacaaaaaaacaaggctcatcccttgggacaccttgcttttagattaatatattttttaataatttgtacgcagaatgattgaagcagcccatcaattagctttaatatgcccagaattaacaccggcgccctgattagttagtggcaaccagttcagtgcttttaatagatagcggtcccagaaatcccactcgtgcgctccagaaccgaccaaatattcatgcgaaacttttttggtcgttagaaaatgatcaaattcatcattcgctgactttaagccgtcctgatcgccaatcgccataaaaatcgcgggtaaagcgacgtgagctgccagtaatttagttacgagcacttgcgggtttaattccgaatgaccagcagctgctagatctgggccaaaaacgccatgctgatatgcgaccgtttccgcaaaccactgaggctttgccggtaacttttccattccgggtcgcacattcagtccggctgataaactcacaatggccccaaaagtatcgtgaaattttagtccgttatacagcgccccgtaaccacccattgataatccgccaataaaagtttggtcacgctggtgtgatagtggaaacgtccggcgtgtaaaatcaatcaattcctgaccaataaattgactatacgtctccccagaccaaggatgatcagtatagaaactattctcgcccgctggcatcacgacagccagattccgttcgtcggcccagcgctggattcgtgtgccactaatccagtcgacttcactacctaagataccgtgcaataagtacagggtggcaaacggaccctgaatcgggcgcggcacgccctgctcatctggaaccaatttatcagttggtaaacacaccatcaggggaacggtccggtgtaaactagccgccataaaattaatacgaatcagtgccatgacacctcagactcctaactattcgttgacacaaacgttgtatacttcatatattgataatgtaatcgcatattagacacttcaaagggtgtcccatcatctaaaaagaagatcccactcatcaggcccaccggttcattcggctgcaaatgtagcaactcttgatcagtcgtattggacgcatcggccgcaatcgataagaatgatttggtcactgcggcgtgcaaggtcttttgcacgtaattaaagatcgatccactgaccacttgtcggttcaactggggcacaagcttgattggaatatagccactttcaatcatgaaaggctggtcatccagtaatcgcagccgtttgatttcataaacaaactcgtcagcagttaaaaataagtcttgttgcaactcttgacttgcaggaatgacgcgaaagtctaataattgaatactgggcttagcaccctcagtatttaaactgtccgtaattcctaggttagttccttcatacttaaacgaagattgatttttaagatataatggattaatgaacgttcccgaaccccgcttcttgaaaatcaggcccttattggctagcacgttaagcgcgcgcttaatcgagctacgacttacctgatactgttcgctaagactacgttcatctggaagcttcttatcaacaaattcattcgccatgatccgtttattgagatcattgatgacttgttgataaactaggtcagccattgtaatccctcctttgaggttatttcatacctcaagtatagcagaattaatggcgtttgggtgaattgttccggtccatttataaaattggaccgtatttttaataaatgtgaggttaacaataatgtcaaaaaagaagaaaaaagatcaattaggtaaaacacttgttgaaaagattttggataaagcaaatatcagctatcaacaatatgaattcccaaccgaaacggaaggcgacgttcaacaattacaagtcgaccacctcggtgttgacgaacatcatatctacaagaccttagcgctgattggtaacaagactggtcccatcgtcggcgtcttgccgttagatgagcacctcagctataaaaaattggctaagctatccggcaacaaaaaagttggcatgattccattaaaggacttggaacgaactaccggataccaacacggcgccaacacaccagttggtatttgggaaactaagaagtttccgatctacttagacgagaccgctaagcagcaaggtaagattctcgtatcttcaggtaaaatcgggcgttcaattgaaatcgacgctgatgatctacgcaagctcgtgcacggcacttttggtccaataacggagtagcctcgtggataacttgatcaagaataacggcatcgtcttgctggtcatcattggtttacccggactattcgcttggttactgacgattatcaaccgacaaaccaaagcgaatctggtcaaccactacggtattaacagtcaagtctactgtggttttctgggcatcatcatccacgagcttagccatctaatcctcgcactgatttttcgccacggcatccaatcggtccggctgctcaaacgccctcacctccatcctgaagatgagtcggcggatgatctggcactaggctatgttaaccatacttggaatcggcacagccggtatcaagtcattggtaacctgttcattggtgtcgcccccatcttcggatgcacagcggcactccttggactagactggctactcgctcctggcctatttcaagccatcttcaaattagctgatacacccgaacaaccgcaatgggctgcaagttttcacgcgttaaccagtacgccaacgagttggtggcaactattaatgttgctctttctaaccctcgtcattgtgattggtggcttcgatctaagtcccgctgactatcagcatagtgcgatcgggttgtatagcaccatcgtcatcattatcgtgctgactaccttactgacgttcatcggtatcaccggttggatccatacgttagttacttggggactaatggtcgccattatcttgggctactcactactcgtgtccctactagtcatgttggtaacccatcttctgaccaaccgtgcctgatttagattgccagccttaaaaccagaataagggctaaaaaggccatcacaagaattcacgatacattcttgtgatggcctttttcgttagccaatataaatggtaattgcatcatctgataacatgatctcagctcaaagaactagtgattcaactagacatagggatgccattacgccttatcatccgccgtccactcagccttaaattggtcaacaaactcgtgcatcaccgctgtccggtgggctgccagcgctttggcagtatccgtattcatgagagctgctaacttgaacaacttttcatagaagtgattgatagccgtgccgggctggtgtcgatattgttcacgcgtcatatgttcacgtggcgcaattgccgggtcatagattttttcaccgacatgacctgaataatacaacgcccgggcgatcccgatagcgccaatcgcgtctaaccgatccgcatcctgaacgacttgcccttcaagacttaatttttgagggccgttgaaggatttgctgaatgacatgtgatcaataattgcaaaaatagccgtttgatcggcagccgtaacattttgcgcgttcaattgatcaatcaaatcttgatgcgccttcgctgggtcggccatcaatttatcgtcgatcacatcatgaagccaagctgccgctaaagtcagatttaaattcgccccttcggcttttgccagccggcgtgctagccggttgacccgctgcaaatgatcgcgaccatgcccactatgatcgtgagcaagcttttgcaaagcatacgtttgaattgccgttaattgtgtttcagttatcatacactcatcctatccctgggtctggtagtacgcccgtagcttcttgatcgttccccggctaaaggtcaagtgatcatgattgtccatactaatcacgcccttattaaaatcaaccgtaatcacatggtcaaggttgagggcataactttgaaactcattaaaaaaatgcatcgctgtcagttgttccttaatcgtatttaaattcttatgtacgacataggactgggtcgtcgtcacgattcgcgtggtccgcagcccatgttccttctcacagtagatgatatctttaagcttcagcgttaataataacgcaccacttcgaatcgttaaagtcggttcagcagattgctgtaacatacctaaccgtttttttacgacttgtaggactctttgtacttctggaacaaactttgccttatcgaacatatttgtttttgaaataaacccggttggtgttgtcatcgcactcaacgtatccgggatcatgtcatcacgcaccgtcacatagacaataaacccatcaggatcataatcacgaatcttagaggccaattgaatgccattgatttcgcgttgtaaaacgatatctaaaaaataaagatttggtccgccgccatcctttaccgccgctaacacatcggtcggctgccatactgagactaactcataattaaagtgcaatgcctccagctgtgccgtaatgatgtcgtttaaccagagacgctgttgttcttgatcgtcactgataaacaccttcatatcaatcactcttcccaatgtaaagcagattaacaaacaaaccactgttgatccactctatcccaatttaaattgcttacaatcattttatatgatactaaagccccgccattccagcaaccaaaaaaacacgtatggaccaaataactgacattacttggtccaccgcattcagcttatttttcaatttgttgtggcttggtctgtacttgattaagtcgcaataattcatccgtgcgcaatttattaacaatcagttgagccgctgcggttgttaaactgtgactgagatcctgatcagaaatcgtaattggatcatcgggatgatgaagttgattcgttaataccgtaataaaattgtcgtaagctcgcttgggatagccagtcgcagtcacttggtcaattccctgacgaattttatccagtggataactcggttttagtaagctaatgacaataatatccgccaattgcataatttgatatttcttcttgactggtgacaagatcactttatgtttgacataattattgatcattgcggcagtaactggatcagcacctaatggctgcaacgtttcattaattaataataggacctgatccatatataagtcaaagttcggtaactcgatccacttcggcagaatcacctttgccatgcgggcctgccaatctgcataagtctcattagctgccatactgcgtcctcctctgataaataggttacattaattatacctagattagctagtcttgtaaactagatgacattgtaaatcacattaatttctgaatatggtatcatttatgggttaatgcaaatacaaatgaaaagtaggttatgcagtatgtatgaaatgaccaaaaagctccgtgtcggtgatgatgttaaagaattgattccacaagcagtgattgccggactttgggaccgtctcaaagcgatgcgcaaagagaaattattgattgatagcacgatggccatcatgttcagtgacgattacgaagacaataaaattttcttcatgacacttcaaaaatccggctcattcgccaatgaatatgaaatggcctatgatgggcccaaagacttcctcggccatgggacgattgttattatcaaagaccgtccccgtacgattcaaatgagcatctcggacgctaataaagctgaagacaccaatgacgatgcgactgatgagcaaaaataggctcgcactttaaatcacatcatgattgctaataagctgctcaggtggtgaccgatattcactgactaccccgaatttgtacctggttatgctacagactttcagattcgtgctcacttaggttgtcacgactgattgctagctctatcaactagttgagacagcaccttgctaacaacacccctaagtgtgcaaaaaaatccgttgtcatcaatgtgtatgtaccgaataaaagcaccgtcaggattcgctgacgatgcttttatttattgtatttctatcttaccttcgctatccgcaacggtttttggcaacgtcacggtcagcagtcctgcttgataatgcgcttgaatctcttcgcgcacgacattcgttagatgaaacttccgggtaaagtccgcgtccatccgttcgcgatggagtacgcgcccgtcatcgttacgatcgtcttgcgaccggtgcgcccgaatagttagccattcgtcagcatacttcaccgtaatagcgtccttatcaaaaccgggtaattctgccgttacggtgtaatcatcgtcatgttcaaccacgtccgttttcatcccaacgtgtgcgtttaagacgttctctgcttcccggtgagcccgcttcaataatttggtgggctttagtagatcatccagatgatgaccgaataattgctggcgcatgtcaataacctccgtatcaaatcaattattagtaagcctgttggtgaatggcttcagcaagtaaatctaaggcatggtcacgcgtgccaacttggtccatatcaaagatgatcgaatcaatgtcgccacctttgaaatcaaattgttcgaagtaaatgtacgggtcttcgccttcaacttttaggaaagcggcttcaatcttttgatcaaaaccagccgcccaatccgcatcgtccatctgattgaaatctgcacgggtcacgtaaccacggtcacgaattaaatccatcgcttttttgacatcactatcttgataaaccaatttcttcgaatcctcatgaatcttagttttcgtttctactggcatcattaaagatctccctttacttggtatacccttagtttagcaccattcattggaaacgttaaccatctttctcgcgatcgcattattggcgcttaaagggttgccagtaggcccgctgactacgatagaccaattaattaaccgtcgcgggggctgacaaaacgggtgataagccttataatattagctacttcgcgttatacttaaagtaactaatattatgaaatgaggaatgtttctttggacagtggccagataattttaaatttagtcattattgtcattacgttcttcgtcgcggctttctttgtggcctgtgagtttgcactcgttcagacccgccctagcgctctcgaagaagaacaaaaaaaacgtgataaaccgtcaaaacggatcgcaacttctttgcacatggtccgcaaccttaacgagtatctttcaaccacccaagtgggggtctcgttagctggtatcattttaggttggattggtgaacaaacaactgaacactttgtgcttgatttcttatccctcttcaacctatccgtctcaaccgcggtattacgaggtattagtatcgtcattggggttttcctactgacctacttagaagtggtcttaaccgaaatcgtgcctaaaaatatcgcaatcgacatgccactcaaagtaatggcggtcattacgacaccattacggtggttccacgtgatgttctacccctttgtatggttgttgaatgtctcatcagctggcgtcgtcaaaatgttaggcattccagttgcgaatgaagataacgatgtttattcacaagccgaaattcttaacctatcacgaaatgccgtaactggcggtgagcttgaacgtaacgattacctttacatggagcgggcatttgagttcaatgacaagatcgctaaggatatcatgatcgaccgtactcagctagttgtgattgatatcaacgataccgtcaagcaagccattcgcgtttatttacagaaacgctttagccgcttacccgtcgtagctaacaatgataaggacaagattctgggttacgtttataactatgacttaattcgccaaggtgaagttgacgatgatattcgggtcaataagttattgcgtaatatcattacaattcctgaaactacaccgattcaagccattctccaaaagatgatcgacaaacaaacgccgatcgtcgtcgtggttgatgaatatggtgggaccagtgggatcgtcactgataaggatatttacgaagaacttttcggaaccgtcaatgacgaaatcgacaatgtttctaacgaatacatcgaaaagcaggccgatggcacttaccgcatcagtggtaagatgaccatctacgactttgaacgctacttcaagaccgacttacaagaatttgaagattccgatgttgtcactttgaccggttatattttggataattttcctaaaatccaagccggtgatacgattcaaatcggtaacttcaatttcaaagcgcttgattttgaaaatgcttatatcaattggtttgaggttagcgcccagacggatagcacacctgacgatcataatgacgatcaaacacaagactaaatatttacacgcactacttaaaatggcacttaaggaagttgatttcttaggggccatttttttgtatccggcgaacttcaactggtcaactttggtacttttatatgataagtcgtgtgaattgccactaacctgttgtacataaattggatgcggttgatttaagggaaagcctactaaaaattaagtttatcttaagccggccgttatcacgacaaactgcgacgattcggagccgtagtcgtttgcaattaagtagtgcccagcgtaaactaaaactaatgtaaaacagaaatgaggaactgctgtgagtgaatcaacaatcaatatcatttatatctccattgaaggcaatacccgctcatttgtcaccggtatgcaggattacgccaagacccagcatgcagctgatgatagcaacccgttaattaccttaaaagaaatcaccgaacagtcagactttgccattgagactgaaccctacttcgcctttgtcccaacctaccttgacggtggtaacggcattgacaatggggttaaggaattgatgaccaacgtgttaggtgaatatcttaactacgatcaaaactcacggttctgtctcggagttgttggttctggtaaccgtaactttaacgatcagtactgtctaaccgctcggcgttatgctgaacaacttgacacggacatgattgcggattatgagcttcgcgggactgccgttgatactgaacgcgtctataacgtgatgaaagaccgtttggccgcctatttagacaatcagaccttttaatcgaattaaccaaacaatcaaggtccaagttagttttcgctaacttggaccttgattgtgttcacagcacgaagttgaccaatcgcctcagtaacgacgatttcacgctattccgttgccttatccttatcaaatatcgtggggccgatgactagtgattccgctaataaggtttcattgtacaatttaaaaacgtacttctgatacttgacctctcgttgtgaaatcatatccaaatattgccgttcttgttcaagtgcattcataaatgcccgcatctctaattctttttctgcaccagtaaattccggtcgccgaacaacgtcaacccaggcacgcgcaaaatcacgagtcctagtccgttgtttctgggtcatcaaatcaaaaatgacggattctttcacattcgacggcaaatacattttctgaactgtatcaatcgcgtggtgaaccatcgccacccgaatctgatcaatctcactagttgcctcatcatcagtcaacgccggctttagcaaccagcgaaaaataatcgtcggcacgaccatactcagaataatcaacgtactagcagccattagaaccaagttaaagtcaccacgtccgaccgcagtatcggttaacgtataggctaaggccagcgttaccgcaccgtgcacgccacctaacgcaaaaatccatgcgggccgatttttgaaactcaaccgcaaccgaccgtagctgtaacgcaccagcacattgctaatatacagaacaagcccaatcaacaaaaagttcaaggacccatgcccgaactgttcgttaacaagaattttgataaacatgaatccaagaaccacaaacaccatgctattaaagatttcagtaatcatgctcaccaagtcaaaagcaaaatgaacttgttgtgcattaattaaccggcttcgttgggcttccgcattatgcactaatcccgcaaccacaaccgtaatgattccagaaacgtgaatcgcctcagcagcataatacaaaataaagggcgtaatcacgtacatcaacagcgacgcattcaacgaattatacgaagagcgtaacaatacttgccgaaacagaaccatgatccaggcactgacaaaaccaaagagtaccccacccacagctgaaataataaaatcaataatcgtttgcccatagttaatatagccattagcataccagagaaccgccatgttcaataagatgatgccagaagcatcattaaacaacgactccatttttaaaaaagttccctcagttgatggcatctccaaaccgttcgtcaccgattccattgccgtggcgtcggtcggcgtactgatagccgctagaataaaagctaacggcaagccgactaatcccagtcctgccaagctaaatcccgcgacaattaaggcaagaatgactagtccaactgtcgtttggataatgtgctttaattccttaccaacagcattcagtcgagtggcttgtccttcaaaaaacaggagtggcgcaacaatcaggccaataaagatttcagaattgaagttttcaatatgattgctcaaaactggaataaaaaacaagccaataccgacgatcagactcaagtagttcacagatatttgcggcattacccgggaaataaaaatactaacaaccgcagccaacaccagaataaaactggaaaccatcaaattcacgtactcacctcattttattaattaattcatttattctatccgataatgctcaaattgtatcgtcaatcgtctccatcatcactttcaaagaatcaaaaaagctttcaaggcatttgaccttaaaagctttgttaatatcacggggcccacctgctccttaaccatttaataagtgttctcgccgggcgcgccacaagactaacgccaaactacctaacattaagatagtcaccgtaataaacaataacgagtaggagaactgagccaccatcatgccaccgaacaatggtcccacagctcgtcccaatgacaaagccatgttgtatcgaccttgatattttccgcgctgatcatcagccgccatatcatcgacccaggcgggtgcaatcggtaagccaatgacctcaccgatcgttaaaaccaccatgataataataaaatcaacgtattgccgggcaaacactaatcccaagaatgataaggcaaatagcgtaatgcccaagccaatctgagtgccaatcttaaatcgttcgttgaataacgccacgatcggctgactcacaataattaatagcccgttaatcgtccaaacttcactataccggcggaacggaatccccaagttggtcatgtgcacggaaagaatactttcccataaggcataactcagataaatggtgaaaatcatcaaacaaatcatccagattaattgacggtgatttttaggcgtcacatcccgcttttgcggcgcagctttctctgtccgaacagtcggtgtgacgttaaaggtacttagcgtaatcgccataaggccaaggtagcaaactgttgccaccatgaacaccacattgatacctagttccaacaagtaaccgaccaataatgtcccaataacgaccccaacgttgagtgctaaataaagcatgttaaaaacataccggttggatctagtcgttaccgttgcggcataggcattgacgactgtcatgctgataccatcaccaaagccgacaatgatcaagccaatcgcgtaaggccacaaactatgccagaaaatcaacgttgttaaaattgcggtcgaaataccaccaccaagtagcgctgtataatatggtcgccagtgatcaaacaagcgcccgccaataaagttaccagcaatcatagccaacgacatcaaaaaaagaataattcccgaaaacgtcaagctttgtttgagataattatgcatgtagaccgttgttaatggccacataaaagcggcacccgcattattcagcaaattggctagaaacagccaccgtaaccgaacttctttttgcatctcctcaccacatttctgatttaagtttattcattgagaaaacaataccctaaatagtatacgccgcctgaccgtttttacctaccaatcaggtcgcaaaaggtgctgagtagtctacgaaatcatttttacttaagccgcgcttagcatcaagtcttacactgcatgttgtttacaatcgcaacgctgtagtcgcagcctaggcccgtgctttgaccatttggtgcattctaaatgcggcccccactccgcggagccgtttcatccgttttagtattgttccgagaagcactgaccacgtgtatactaaagtcaaaaaggagcaattgacatgagacttttcaccattccagccgaacaaacggcatttagtaccaaagaggttgtcgccatcaccggtatgaccaaggacgccctccgttattatgaacaacaacggttgattgggcccgtaccacgcaaccacaacaactaccgacagtattcacgtcaaaatttagagcgtctacaattcgttgccacttttcggcaattaggccttgatctaaaactactcagcggtgacggccacattccaaaccgggcccagcgaatccaagaactgagcgcatatcgtgctactgtgaaaaagcaaatcgctcaattacaggcaactgatcagtttttagcacataagattgcttactttgaggcttctccaaatcattaaccaacttttttactttttacttgctatcgtgtggacactatagtttatactaacggcacacttaatcaaagaaggttacgatattatgaaaacaattgctattaaccaatacggttccgcagatgaatttacgatggtcgacatgcccacgaccgaaccacaagctgatgaagttcaagttgcgattcacgcctttagtctcaatcccatggatattgctggccggatgggagccctatcctcaccctttactgacttatgggcctttccattggtcttaggttgagatttcgctggtgtcattaccaaaatgggcaaggccgtcactggttttaacatcggtgacgctgtgtttggttccgccgcgcctgcccacgcagctaataacggcacttatggtgaatttattactgttaatactaaagaattagcccatctcccagcaggcttatcatttgatcaagctgctactttgccaatcgctggactaaccgcttattacggcatgaagcacaatcttaagctgcaatccggacagaagattctggtgcagggtggagctggtggtgttggcctctttgcaattcaaattgctaaagcctttggcgcttacgtcgcgaccaccgctagtgctaatcaccgtgacttgttaactcgcctaggggccgatgaagtcattgattaccacgaaaccgatcctgccgccgtcttgcacgactatgatgccgtttttgacaccgttggtgatattgatactggtctcaaggtcctaaaagctgacggccagctcgcaaccattgccggccaaccgacggacgagcagcaacatgatcaacagaaaaaagttgcctttcagttcacccaaggctcatcacaagacctagccgacttagcccaattagttgtcagcggtcaagtgaagctaaccgttgcgacattaccgttctccgtagccaatgtcattaagggtcatcgatccatcgaaagtcgccatacgacgggtaaaatcgtcattcacgtgacggattaaccaatcctgctactcgataaatatcttccggcaccattcttagtagctagtcccactgtaaaaatgaacgttcagagttcgaaggacttctgaacgttcatttttattttagcggcccaattagccatggcacacttggtagcaaaccaaccaatttaatttaatgaatcactttaaacttcgcagcacacttaacaaccagttataattcacgatgccatgatgaatttgaactaagttcaaactgtctcaaccaggtcgtactaatattaattcgacaatccataaaaattaatattgaaatgtccggtttttgaacctgattgtcgactaccacccctgatgattgttataatataattaaacactgccaaccggtgtaatctttcaacaattgaggtgacaacatggcgaataacaactttggcttggcgttaggcttcctagtgattctgttgctctggatctatcaacgcgtgcgaatgcctaagatgcgctcactcgctggctacatgtcgcgacgcgcgattgaaaatgaggaaacatggcggttcgcacaacgcttctattcaatgtttggcatcgaaatcttttccattttgttaatcggcgcgattattggtggtctgttcaagattccgctattgcaaagctttaattttcaagccatcgccttagcggttggtttgatcatgcaaaacgttgcaactgagcgtgaactgaaacaccagttcccaaaatctccgcaacattagtactttataattgaccatcaccacgtatggtttaatattaatacggtagtttaatctgaattaatgcttatgaacaagtacttggtttaaaatattcttagtaaagaagtgaaattgatgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaggaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgccggcgatgatgctaaagcttaccgcgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcacgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattctcacgatgctgaagccacggctggtagcccagaagcttacgaacgtttgcttcacgatgccttaaatggcgacgcaaccaacttcacccactggcaagaggttgccgattcgtggaaattcgttgacgtcattcaaaaatactgggatgaacatcaacccgaatttccaaactaccgccctggtacaatgggaccagatgcggccgatgaattattacgtcaagatggtcaccgctgggtctaccgcaactagccgtcctagcgtattcacttaaatggcttaattaaaagaaccagttaccaacacttgcctaacaacgtgttgataactggtcctttttatatcgctttaacaattggatgggttgctgcccatcggcaatacacgtttattttgctcttcgggattgcgcctgcggattagcttaactagcgtcgcaataatccctaacaccacccattccgcttataaacgcctaccctaccagttgttcacaaacttgaatcaaccgtttgacaccggtcgtcaactctgacagtgtcagcccggcaaaccctaacaagtaatagtccgccgtgggcatgtcgcgccaattggagttaagcggataaatccgaacctgttgccgttctagggcttctaataatttagcctgtgcaatgcctggaatctgaacaactaagtgtacccccgcgccggttgcaattggtcggatctgcttagtttgcgctaactggtgacaaagtacccgatacttttgtcgattagcagctcggtttcgactaaggtgccgataatacgccccatcttcaaaataattagccattgcttgttgtaacaggccggccaccatttcagcccgatattgataccgttgatgataagttgccaccagttgtggtggtaagaccaaatatcccatccgtaatgtcggatcaattccccgcgaaaatgtccccaaataagccacctgattagccgttgctagcgactgtagcgcgggtaatgggtgcgcactgtatcggtattcactatcataatcatcctcaatgatgagatgctgagtccccgcccattgtaacaacgctaatcgtttctcgatgggcaagacgactcctaatggaaattgatggccaggggtcgtataaatgatctgagaattacgcgcacgaacttgtgtcaaatcgagcccatcttccgtcactctgatggggaccgccgtctgtccataactagccgccaattcggataaaccgcggtagcctggattctcaattccgaccgttccgcgtggcaagatactaagtagaatactgagacctgccttagccccactcgtgatgacaatctggtccgctgtgcaccgcacaccacgagtcgttttcaaaaatcgaaccaagttttcacgtaaagccggtaagccctgcgcatccggataaacggccgttggttgctgctcagtctgacgcaacgctagtcggacagcccgtttccaagcgttccaacttggcgataacaactgagtcacaccataccgaaaatcataagtgaacgccctgggtttagtgggctgtggcacagtctccagcgcctgtttagctgctggccagtgtgtccgatcgcgataaaagtagccactcccgggaacggtataaacatagccctctgctagcaactgatcgtaagcttgttcgacagtggtcttggaaactcccaaattttgtgccattttacgaattgaccataactggtggttggcttgagtagcatcatagtcatcacgcatctgctggtataactgaatatataacggtgtcgttgactgacgatttaatggcatcacacaactgtcctttcatttttatcaaaattgtctatttctagccggacgattgttgtttattataaacggtaatcacgttgagaggaaggtcctaatgatgaatacaaatattcggatccaacaaattcaagtctctggcatccgacgcttcgatgaagcaatcagtcaaattcccgatattatcagattaacggtcggcgaacctgacttacccaccccaagtcacgtaaaaaaagcggcaattcaagctattcataatgattggacacactactcgccactaatgggatttgccgctttgcaagatgctgcgagtcactactttcaacagaaataccaactcacctatgcacctgagcaaatcattgcaacagtcggcgctagtgaagccgtggcaacgaccctgctcactttacttaatcctggcgataccgtcttattgccaacaccggcttacacgagctatcaacccgtcgttgacatcgcaaacgcacaattagctcccattgacacaaccgcaacgggttataaattaacacccagtgcgttacaagctgcgctagatgatcaccgtcgcgaccacgtcaaggccttaattataaactacccgaccaaccccaccggcgtcacgtacactgatgatgaattacgggctttgcaagccgtcattgctaccgccggaatctacgttattagcgatgagatttacagtgaactaacctatgaacagccccatactgcttttgccacactatatccaagcaaaacgatcacaatcaatggcctctccaaatcgcatgccatgactggttggcgactgggattcatcatggccccaagtaacttgattaccgagatgaagaagacccaccagtacctcgttacttcaacgagttcaatcacccaagcggctggtatcgaagcacttacccatggtctggatgatggctcagaaatgcgtgacgtctatcaaacacgccgcgattacgtcgtcaaacgtctgagtgaaattggattcaattatatctatccgacgggcgcattctatatctttgtccagctaccacaggatttccaaggcaccagctgggactttgcgacccgactcgcacacgaggcccaagttgctgtcgttcctggctcagcatttggtacgagtggcgagggttggttccggataagttatgcagccagtcaatcggcactacgcgaagggctaaatcgtttagccttatggcgcgcccaaactaccacacaggaggattagccacatgaatttagcatccgcacacctgattaccgctatggtcaccccatttgatgaccaacaacacattgatttccaccgcttagagcaactgatcgaacacttacttgcaactggcacggacggcttattagtcgggggcacgactggcgaaggccccacgttgagcatcgctgaaaaacgagatttatacacgcagacagctaggatcgttgctgggcgagttccaatcatcgctaatacggggaccaatgacactgccgccacaattcatttcacccacattgtcagtcaaatcgagggcatcgacgccgccctcgtcgttgtcccgccctataacaaacccaaccaaaccgggatgatggcgcattttacagccattgccgaaaaatcagacttgcccattataatttataatattcccggtcgcgtaggcgttaagatgacggtcacgactattctgacgttggcccacaaccccaacattattggaatcaaacaatgtggttccgatgaagaattggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcgccttgaaccacggcgatatcacccaagcagggcaaattcaacgacgtttaatgccgaagatggcagcactattcacacaaccctcaccggcacccgtcaaagcggcgctgaacgcccaacactggttagtcggaagcacgcgcctaccaattttaccgttaaccaccaatgaacaaagtcaactactcaacagcttaaaataatgcagaacggttggtagtacctggcaaaagcgcgtatactgaaactaaaataattaggaaagtggtgaccatgatgtgcggttgggcttttactggcggtatgccctttatgtggatgggtggcggcttgggcattatcagcttactgattctgttagccgttggtgcttactttttagggacacgttcacgccatcacgattaaagttctcattgggataatcaaaaaagactttcaaggcacggcttgaaagtcttttttgtttcatcatcagggatcagccaaccgggtcaaaccctccccatttcaggttacctgcagttttgcctgatagtatcagcccaaacgctgatttagacccgatgacttaatttcaagatcgtaacgtaagtaagtttaccagccttaacattgctattgagtttgtccccactaacttcattttcactcacaatccataagccgatttgaacaaactggccgccagtcccaatgccccgattccaatcacaattttaagtaatctggcaggtaagtggcgtacaattcgtggtcctaagctaccaccaattagaaaaccaatgcctaagggtaatacatagcgccactgaattggcgtttgtaggccataaacaacggctgaaacaatattggctaaacccaacgccagatttttctgagcattatagacgacgaacggtgcggcactcgtgaaagacaggatcgacaacatcaagacaccacccgcagcaccaaaataccccgtataagctccgactaaaaagatgcccaaccaagctaaagccgtcatccatttaggtgtcacaacaatttcaccgggctgtttaatatgaatatgacgaggaatcagcactaaaattcccgcaatcaaaataaaaaatgggacgaccttcgcaaaggtcgctgccgggataataaataacagaattgccccaacaatactcccaactaaagtcagcgggatgagcgtcttcaattcctgaccatgcccccgtagttcccggcgtgaggccggcacggctccaaagctagtaaagactaaacccacggtgttagtgacattagccgtaacgggcggcagtcccagcgccagtaggaccgggtacgaaaccagcgacgctaaccccgctgcagtgctaacgatacccgcaacaatcccaacaacgactaaaataacgattaactctccgaacgtaaacatgtacaacgttcccttctctcttaatagccctacaatagccacaacgattaccatagtcaaataaccatgttataataacaaatcataatactaacaattaagcatcaattaaataaggactttaaaatgaatattaaagatttgcaatattatgtttcgttaactcagctgaaaaatttttcattagttgcagcccaatttcacgttagtcaaccgaccatttcggctgctattcggcgcttggagaccgaactgaaaacacaattactaattcgggctaatccccacttacccgtggcactcaccacgaccgggattcaagtccaacgacacgccaatcagatcctattagagcaccaactgatgtgccaagaagttgcccacaccacaaccgatcaacttgtcatcgggatgccgccaatcattgaaatcaactactttccccggattgcaagtcaattaccacaggctttattcagccagattcaacctatcagtcaaggttcactcgcggcgctcaaaggattaaaaaacggacaattagacttagccgtacttgcttacctcaatgaattcacggatacgaccattcaactcacgacgtttgacacccagtcatttagtattgttgtaccaactgacgatccgctagcaaccaactcacaacttcagttcagatcgttgcgtcatcagcattttgtggcgctcaaagataactttgtccaccgccaggcgtttcgtcaactcagtcatcaaaatcatgttcggccaacgattgtctttgaatccaacgaaatcggcagtatcttaaacatggttcgtcagcatgtgggcattgccttattgagtaacgccgtccaattaccggcgggattacagcggctccccctaactgacgcgcaagcgcccacgttcaatgtcggcgttgcgtaccgccactcaatgacgtttagtccaacccaagccgacctgatccaacgactgaccgctgcttttcaatccgtcgattggcacgcatactaaccagcacctaaaaatccaccgtgtaagtttatcaatatgataagctcacacggtggattttataacgactgtacgtcaagttaggtcgccaaatgcaggtcattaaacagacaagttttagtaacctatcatggtcgctaacccgtctcaacctcagattaagcttgttgaacagccttcgagattggggtatcgccattgatcaacgcaatggttttaccgaccgttgcaggggtgtgtagcgtttgaactgtaaaagttgcgacatcatcacgcgtaatctcaccgccaacgtcagggttaacggttactttgccagtaccggcatcattgatcagcgtacctggttgtaaaatggtgtaatccaattgggttctgttttttaaccattcgtcagcataatactttgccacgtagtacggttgtaatgctcgtggccaacgactccgatccggtgtaaattcagcactaataattacgtagcgtttaacgccggcaattttggctgcgaccattgatttgacagccccatccaagtcaatcattaaagtcatatcataacccgtttgaccacctgatccggctgcaaaaacaatggcatccataccattaaaagccaacgctaaatcttcaggctgagccatcaaattgaattgtactggctgcgcaccagcatcctcgaaagcctcagcctgttctggttggcgaatacccgcgtacacttggtcaccttgggcaactaacttggaaacgattttcttaccaatctgcccatgggcaccaatcacaaagattttcatctgggtcactcctgtcctttagttaagtttcattataaagcttaccaggacaaaaaagtatcattctgttcctgatttgtccagtttacaaaattggcttataatatgagcatctaaacgagagtagtgataattcatgtcaaaatatattcgtcaagctactagtgctgacttaccagccatgatggctattatcgaacagggcaaacacgccttggctgccgatcagattccccaatggcaagatggttacccgttagctgctgatattcaggctgacattgatgctagaattgcctgggtactcattgtcgatgatcagattgctgggacggctgcactgctaacaacacctgaccccaattacgctattatttatgatggcagctgggcgcctactgagaaccaccgctatgcctcgattcaccgtattgctattgccaatggttaccacggacaacatctgactgacttttactttagcaatctcattaccatgagttaccaactcggctttcgtcaactccgaattgatacgcacttgttaaacaagcgaatgcaacacattattaccaaagctggcttcgaataccgtggtatcgtctacatgaatcatgacaacaacgatcaacggaatgcttatcagttactactatcctaatatttgtcagccacgcggcatttggctttaaacatcacgaacgctttaattaagaccaaactcaacaaaaagcacgccagattattctgacgtgctttttccaactttgtaagcaccacctgacagccaaacttaattaactggcacaaacacctgttgtggcagtgagtacaaatactgtttagtcacctttcctggatacatcgacgctagcgctgctgcatatagtttaacttgaccagcgtagcgcgtcttcaattcttcaggccgcttgacgtggtccgtcttataatcaaacaaggttaacccatcagccgtttctaaatagccgtcaataattccatgaatcaggacttttcccgtctcatgttcatcaacatcgaaaatctgacgtgctggaatcagtaacgagaatggcacttcgcggtgcaccttcgccggattatccaaaatttgactgcccagcgcactctggtaaaaagccacgatggtgtcaactgcaatcaatttcgcgacattggtcgttaagacccggttagccactaacccatcaatcgtactttgaaccgttgtttcattgaccggtttggtcaaatcaagttgttctaaaactaagtgggtcgcactcccaacttccgcactggttggcgcctgcatagtttgtaaaaattgtggtaactccagtgaccctgtcacaaaccgggatgtcggtcgtgaacgccgctgactaacagtcgggttcgcattcatcagcggagtatccggatcttcaaagattcgtttcacttctgataccgattgatatgccgtcgtcgtcgtggaagcctggtgtggataatgaaaattcagtaacgtggtcagataatcacgcgttacttgatcaacatcgatggtgacttgctgttcaactagttcaagcgcatcaggttgagtacccgataccgcttcactttgctccgccaggacggtggtggcatctcccaattcaacggctagcttggtcggatcatccgtcaattcgtaattgggccattcatctccccaatatgccttcatggccggatgccgtatcacggccataccgacccaatctaattgattagtcgccgcaatccgtgcttgggcacttaagacgcgcccgtcgctagcaaaggcctgccgccatttttcggtcgcggtatcaatatccttgattgttccaaccaaatagagctgttgctgagctcgcgtcatcgcgacatatagtttccgcatctcttcagcgcgcatcttcttgctgactacctgcttagtcacaacttgtggcaaggtcgggtacttcacacgcgtttctgggtccaaataagtaatcccaatccccgcttctcggtccaatagcgcgcttgagcgcgtatcagtctgattgaactgcttatccatatccatcacaaaaatcacggggtattcaagccccttgctaccatgaatcgtcattacgttgaccgcttccgcatcagtctcggccacggcagctgccaagtcctgatccttttcctgcatccggcgaataaaacgaacgaactgaaataagcccttaaaactgccctgttcatacgtataagcacgttcatataaagcgtggagattagcctgacgctgtttaccagccggcatgccgccaacgtagtctaaaaagccagttcgttcatagatttgccaaatcagggttacgatttgattacgtcgtgccagatctcgaaattcagtcaattgtgtcaagaaggtctcgatcttagcataaacttgatcaccatattcagtcgccggaccagtcggataatgatgataaaagtcctggacggcttgaaaataatcactcgttttattctggatacgcaaataaactaattgattttcgtctaatccgacaattggcgagcgtagaaccgccactaacggaatatcttgatatggattatcgataatactgagtagtgccatcatgattcgaatctcagtggtttgaaaataattctgggcatcattgaccacaacgggaatgtgataccgtttgaaaacatcaataattgttaaattatgattacgtgttggtactagtaacgccacgtcgctgtaacgaaacggccggtattccccattagcacgttcatagattggcttatcttgggccttaagtgccaaaatcttttgggcgaccatcgtgatactcccaacggcaggatcatcaattgaaaaattggtttcatccgtggagacatcttctgtcgacttgtcagtttccgtctggtaaagtaatagattcgtcgtttgtggcatatcggccggataatccttgggcccatacttgaggtaagccgcttcatcataatcaatttgcccgaccggcgcgtccatcagctgactaaagattaggttagtcaaatgatcgacattcgccaccgaccggaagttttcagctaatacgattcgttccccgtgttcgggattcgtcccaaaatcgtgatacttgtgcaaaaacaataacggatcagctaatcggaactggtaaatcgactgtttgacgtctcccaccatgaacatatttcctggctggtcgcgcgccaacagctgcaaaatactttcttgcaaagagttaatatcttgatattcatcaaccataacttcttcaaattgggcccgtaactgcgccaaagctgcctgaccactttcattgtcactcgttaagatttgcaacgttaggtgttccaaatccgaaaagtccaggacgtgtcgccgccgtttttcagctgcaaaagccgtcttaaactgcttggtcgcatccactagctcagtcacaattgactttgcccctaccataatatctaagacttgctgctcatcggccgcaaaataagtctcgctaagggtggtcatttgtttcttgacaccgtccacaaatgtgcccatagttttggcccgtgcagtcttctccggctcgtccttataagtttttttgagagctccaatcttgaaagtggcgacttgagtacgtaactcattccaacttgccgttgccaattgttcacggagcgtcgtcagcgttttttgtgctgtagcgagtacctcaagcgttttcgggactaagtcagcatccgtcgcaactttttgcgcctgtcgtaatttcatttgcatcccatcgacttcattaatgagcaatggtaataattgttgttgataaaaggcactggccgttaacgcttcctcatccacctgataaggttctggtaacttgctcagccagccttccggatccggggtcgactgggcaaaatcaaataaccgaaaaatcaatcgactgagaccatcatcacttcgatcattagaaaaattcgctgttaataagtcaaataacgtaccatcttcatcatataattgttcacgaacactgtcccaaacctgatcacgaatgagtaacccctcagtgttgtccgtcaataggcgaaaaacaggatccaaatcaataacgtagtaataacgctgaatcacgcggagacaaaaagcatccaacgtactaatgttggctaccccgagcaaatttaattgctgccgtaattgccgaatcgctggtgacgccgtggtttgcgccggattgtccgtcattaactgtgagattcgcttattgatttgcgattccagcttttgtttcatatgcttggcagctaagtttgtaaacgtcaccacgagtaactggtcaatattcgtgccggccaatatcttgcgcataatacgttcgatcaatacggtcgtctttccagaaccagccgaagctgaaactaacaagttatttccctgctgtgcgataacagcttgctggctaggtgtatagtttgtaccctcactcatggttttctccacctttctgtgtctttagtaaatcaagaacctgtttggctgataatggcggtagatcccgataagcattttctgccaacattgcatcaaactgcataattgatagatacggcgaatactgtaaagcagtcgtcttatcgttcagccgaattggatttagttgaatttctccagcgaaaattgcttcagcagctgcaataatcaattgactattatgctgtaataatcgttccaactggtcattcgtcaccagtgaagctgcacgccccccactatacgccccgtcctttttacgtgcgaatgggtaaactttcgaggtcccgttaccttgttgtagttcgctatctaaatgttccaataactgcggatcatcgagcaaaattcccttatacttgttcttctttaggagtgctgcttcaaaaccgccctgaatatcttttggtttcagagttggattttgaatgtgcatgtaaagtgcgccagctaatttaaccgcagcttgatcagaaccgactaaagcttgctcgttatgcagcacagcgtccaaataagttaacatttgcattgcgagaccatagtaagcctcttgaaaatcaaatttatgttgggatgacttataatcgacgattcccaggtaactttgatctgccacttgaatttggtcgagacggtcaatcttcccccgcacgtgcacactatgcgttgcatcaatttgaaaatcgagcgcttttaatccgtgttccttgccaacgttaccaaataagacctcggtttgcttcggttcagcggctgacagtttactttgattgcgaatcgcaaatgcaatctgccggactgtgttgattaactgccgttgcaagtaagccatccggttagaactcgtcaaaattgtaaactgtggttgatctaagatttgacgggtcacagtctctaaatactgtcctaactgctgatcactggcttgggccaatgggatttgatcagaccgtaacgccttgatgagcccatctaagacagcgtggaaaaactccccagtactagcagctgataactcgaacacatcacgctcacgcagtttgagcccatatttcaagaaataagcgtactgattacgataaaattcttctagttttgaaattgacgtataaatttgatgcccatacaaagcctcaacgctggctggtgtcagcttgacaggttgattgcgatagcttaatccagccatcaattgacgtgctagctcaccgaattgggggtcacgcgtcaattgttgccgtaaccacacccacaccggagcaggttgtaatggtgcgccaacacgattacggtcagtattcgtcgttaacacatcgcggtaaacctgaatcacatgactaatcgtccggcgcttagtcccaacaaatggccgcgcatcggcattagtcggatcaggcgtcccaagataagtatgttctcgcaaattgaactggcgttgaattcgccgcacatagttggaccaatttaaatctgtttcttgatcatcttttaacggggcgctgaaaaacaagtgtcgacgggcacttaaaaaggccaaataattcagacaactttcatcaccgagctgaacgacagctgaatcatttaaatagtggtcaccatctaacgaactgagcgttggttgcaaattttctttatccacatcactcaataagttgttcgtcataatccggtcaggcatcactaaatcggttgccccaaccatgaagacaactttatggtcctgactttgaaccattccgctctctgaaattaacacctggtccaacgtcgacggaatttgcgagtaactagcaccttcaaagcccgcttgtaatagtgccaaaaagtccgtaatttcaaatggctctgcacctaaaatcgtcacgtattcatctagcatcccacagaaagtttgccaggtctgctcaggctcggcagctgcccggacatcttggcgatccaaggcttgatcacgccaagctaatagctggtccgtaacgccctggcttgtcaaaaagttgaccagcaatgtcacggccgctttgccatccggtgcttgccgcatttttttaaaaaacggtggtaacgtttcagcaacaaagtgatgaatcaagttgatttgtcgcgaaatttcagcattttggtccgtctcgaccccggcatcaccctcggttaattgaaagtattgccaatcttccctttgtacccaccgctggccgtgataaccacttttaaggataaagttttcggtcagatctactgcttggcggtaggcttgccgatccatcggttgcccattgatatttggcatcaacagctcggttttcaacactcgcataacatcacgatattgatactgctgtgcgtcgatatcaaacaacgcgttaatcaactcaactaacggatggtcggccattgaacgctgtaaatcaacaaagtatggtatttctaattcatgaaaagtcggcgctaacatcgtttggtaggcatctaagtgccgtgtcatgatcaagaagtcccgataatgataatcgtcggcgggatcggcatgttttttcgcgaccattgcccgaatcatgcggccaacttgtgccaattcggtctgtcgactatcggtccggaataaatgcacattcgtattcggctcctcgtaaccggtagccgcttggggctgaccacgccaaaaatcatcgagagccactaagccgggagccacgcgcggcgtttcagcataaatatcttggctaaccggaatctgacgaatacgggcatactgataaagccgataataaagccgaccagattgataaaacagcgtgccattttctggcgcccggtcaacgactttgtgatcgagcatcaaactgattgtcacgtccgcgccctgttccagcatagtcgtgacgattccctgttcctgggccggtaattgggcaaagccagcgagttccacataaacgtgcgttccgtgcaagtcttgacgccgtaagtaagcattcaattgaacgagaatatcagcgggcttaagatacttatctgcagtcgccgccacgaagtctttgtaaacgatcgccagatcatgtagcttagcctgcaagtcacccgcctgagcattcgctgccaattgaaccacatcttctggttgcaaattagcggtctgtaactcattaatttcacgagctagttgagtcacaaaacccgtttgcgagatttcaccaccaaacaatcgcagctcatcggcatgtcgttgtagaatgcgatataatagcatgtcaatcccagcagcggagagtcgtggtacttgataagctgcttcgttcttcatcaagtaccaagcaagacgggtaaatgaaaagacctgaacctgagtctgggcatacaaatctggttgcccaaatgcctgtgccaagcggttcaacacgtcaacttcagtatcgaacttaatatggttcggtaccaaataaaaaaactgatcttgtggcttagccatcaaggttgccactaactgcgccaccatggtacggcgatggtccatcttggctggtcccaatacaaattgtaagctcaccactaattcctcctctgaactgaacaaacgttctcattaagttagtctcattatcgcatatttaaccggctaaaaaaacacctaacccgtaagttagatgtttattatcgcgtccattaaataccacgttattcagccaggtgacccgtgtgctgcacgtcttaattctcaacgttgacggccactgctgccagatgtgcgtcggatttataatggcttatcgtgcccggcatccagtaccgttttgtcatcctgatttgaaattttagaagctttaacgaacgtggtcacggcttaatgtgggcaactcgcacggccgcttattcatccggctgcaagcctcgacctcaaaacaccttaccgatcacccggtgacactcgccaatcctcagagtgcttaaaagacacgaattagcacaacccccacaatcatgacgagcaagcccatcaactggacccccgaaattgggttcttttttgaagcaaaccagccaaattggtcaatcattaaactaccggccatcagtccgactaaaacaatgacgaccgctaaaccagtgccaacgaccggaaccaagtaaacattacccaaaacatacagcgcaccaatcatgccaccaatccacatccaccaaggattaggcgtcttagttggcctaatcaatttgaattgaggtcgcaagactaacacgatgacgatcagtcccagagtaccaactaaaaaagaaacaaatgccgcgtgcactgtggagccaagcacccgacctaggtgcccattgaccgcagtttgcatcgcactgagcattccggcaaccacacctagtgcacgccaaattccaaggccactttggtcagtgtcagtagctgtatctttttccgctgtttcagtgattcgattatgccgctgttcgagccacccctgagccgcaacggtgatgatgacccccgccaagactaaaattgcacccaaaaatcgggtcatcgtcaatgtactttggggtgagtcgaaccaaccaaaattatcaatcaatagcccggccaaaatttgaccaagcacgggcataataacggtttgaacactacccagcttcggaaacaacaagatattgccagttaagtagacgacccccaatagcccacccagccaaatccaaaccggttgactcgtaaataacgtcgtcgaaaatcctaaagtatggacatcaattagtgtcattatcgccaaaaacaacgtccccacagcaaaagatattagggaggcgccaaatggagatcccactgaattgcgcaatcgcgaattaatactcgtttgcattggtaacccaatcccgattgctaagccaactaaaattgctaacatcgaatattccctcatttctttatattgtcttaacaatctgtcacaggttaatattagcacgagccggtaactaaaatagtcatgaaaatcgtctggataatccagcttaattttcatgactattttaaatatgccagccatttatggcgcgtaatcctaatcagtcactccccagtgttctgggtcctgacgccacgtatgcagcgaagctaattcttcgtcatcaatgtaatctgcttggcgagcaactttgattagttcaggatagttggacaaactgaacagcggtaatgacgcagcggcaaagttttgcgttgccgcatccaaggcataactgaagattgctccaacagcctgaatatcgccacctgctgcttgaacggccttagccgcctgtaacacactgccacccgtcgaaatcagatcatccagcatgacaactttttgaccgggctttaacaccccttcgatttgccggccagcaccgtgatccttgggtttagcacgaacgtagatcaatggtagatttaacaattccgccacccaggctgcatggggaatgccagccgttgcgacccccgcaatcacttcggtcgccgggtattcacgcttgatgatggcggcgattccgtgcgcggtatgctggcggaccgccggataagaaatcgtcagccgattgtccgtataaattggacttttaatgccactggcccaggtgaatgggtcgtttggtcgtagtgtaacggctttaatcgtcaacaaatcagtggcgatagttgctgcaatttcactcatattagttactccattctgtcataatgtctcggtaagcttgaactggttctgcagcctgcgtaattggccgcccgatgacgagaccgttgctcccagccttagcagcggcagccggtgtcatcacccgttgctggtcatctgactgcgccgacgctggccgaattcccggcgtaattccgagaaaatcggcaccgacggccgtatgaatcgcctgaacttcttgggcggaacaaatgacgccatcacagtcactcgcccgtgctagtttggcataatgcacgacactcgcccgaatcgttcccatgatttgctggtcctgattcaaaatagcttgattagtcgaagttaactgcgtaatcgctaataacttgggggcagtgactccagcggccattgcacccgcgaccaatcctcgtttggcggctgaaagcatcacgtgcccacccgcagcatgaaccgttgtataggttacccctaaccgcccgatcacccgcattgcggattcgacggtattgggaatatcatgtagtttcaaatctaagaaaaccgcatggccgcgagcttgcacgtccgtcacaatactcggtcccgctgcataaaataactccatgccgattttgacagtgacatgtaaatcagccggaaattggtctaaaaaagctaaggcccgttcggcggtgggaaaatctaacgcaatgataattggtcgcttcatccttggacctcctgaatcaacgcttgcaagctggtgatcccgtactgatccatcgccgccggtaatccagcaataatgtctgtacaagcagtcgggtgaccatacgttgcggccccaacttgaacagcatttgcaccagccaggtaaaattccaacacatcagccggcgtgaacacgccaccaacgccaataatcggcaacttggtatgttgacgcacgtcatggatcatccgaacagcaagtggatgaatggcttttccagataaaccgcccgtaccatgcgctaagatcggttgacgtgtggctaaatcgatgcccatacccgttaacgtgttaatcatcgtcagtccagccgctccaccagcttcggcagcgagtgcaattgggacaatatcagtgacattcggggtcagcttcatgaaaactggtttatcgaccgcggcaacaatcgccttagtcaacgccgttaccgtcgctggatcagttccaaatgctaggccgccatggtcgacgtttggacatgaaatattgatttccaataatttgacgttaggtgccgacgccatttttcgtgcgactgccacgtattcatcaaagctcgcccccgcgacactcccaataatcggtaaatctggataatgagtcgctaaccacggtaatttatcggccagcacattgtcaattccgggatttttgagtccaattgcattgagccaccccgcggttgtttccgcggtcgttggtcgtgggttgcccgctttcggttcggcggtggtcgacttgatgaccaagccccccaacgcactcaggtctaactgttgagccatctgttgaccatatgccgccgtaccactagccggcataaccggatttttgaacgtgacaccggctaaatttactgttaatcgtcccatcgttttcctcctatgatcaagcttatcggcgggtgtcctgatttagagcgcctgcgttacaaatgactgtgattctcgtacttgcaaaattgccgcgaccgtatctaaggccgtaaacaatggaataccgtgcataattgacgtgtttcgaatcagggtaccatcattttcagcctgttcttcatccgaaaccgtattaatgacgacttgaatttcgccagcttccatgcgatgcagtaaatcatgctcgccactatcgatcttgtcgacggtcgtaacgggtaacccgtgtgtggtcagagcagtcgccgttccccgagtcgctagcaattggtagcccaacgcatggaaccgcttggctaacgccactgtttctggcttgtcttcatcccggacagtcaaaagtacgttaccatggctcggcacgtgtagcttagccgcttcaaaggctttgtaaagtgcctttgccatcgtgacatcgctgcccatgacttcacccgttgacttcatttctggtcccaacaaactatccacacgattcaactttgaaaatgaaaagaccggcgctttgacgtgtactaagggacccggtgtgaccaagccagtctgataaccttgttcagccaatgactggccaaggattgcccgagtcgcaacttgagccatcggaatgttcgtgaccttgcttaagaatggcaccgtccggctcgcgcgcggattgacttcaatcacataaacttggtcgtcgtggattacgaattgaatgttcatcatcccgacacagttgagcgcaatggctaatttttcagtataatccacaatttgtgcttggaccgccgccgaaagtgactgtggtggataaacggccatcgaatcgccagaatggacacccgcccgttcgatgtgttccataattcccggaatcaagactgtttgaccgtcacaaatggcatcaacttcacattccttcccgaccaaataactgtccactaaaacggggtggtcatgcgacaccttgaccgcgttatgcatgtaatagtctaagtcggtccgcttcttgacaatttccatcgcccggccaccaaggacataactgggccggacaaggacgggatagcccaacttatccgcaatagctagcgcggttgcttcatcacttgccgtatcaccagccggttgtggaatagctaaagctttgatgaccttatcaaattcgtcacggtcttccgcacggttgacatccgccacactcgtccctaatattttgataccatggtcagccaatggtttcgctaagttaatcgctgtttgaccaccaaattgcacaatcacgcccactggtttttcaagttcgatcacgtttaagacatcttcaatcgtcagtggctcgaagtacaatttgtctgatactgagaaatcggtcgagacggtttccggattactattcatgataatcgcttcatagccagctttttgaatggctttaacggagtgaacggtagcatagtcgaattccaccccttgcccaatgcgaatcggccctgaccctaacactaaaacggatgggcgtttcgtgacaatactctcattttcaaactcataagtgccgtagtaataaggtgtctccgaagcaaactcaccggcacaagtatcgaccatcttataaacgggcgctagtttgtgcgctaagcggaagtcgcgaacctgatcgattgtttcgtgccaatagtcagctaccgtttgatcggcgaagccattgcgtttagcaacagttagtgtctctatgtcatccgtatgggtacgcaaagcttgttcgatttcaataatgtgtaatagtttatccaggaagaacacgttgatcttggtgagttcggctaattcatcaatcgggtaaccgcggcgaattgcttccgttaagtagaataaccgatcatcctgcgcatgaatgagcttatcgctgagtacatcatcatcaacactacgcaaagcgggttcttcaacgtggtgcactccaatttctagtgatcggaccgcctttagtgtggcttcttcaatattgcgcccaatcgccatgacttcgccggtcgccttcatctgagtgcccaaacgacgatcagcatgggtgaacttatcaaacggccagcgaggaatcttgcaaactacatagtccaacgctggctcgaattcagcgtaagtggttcccgtcaccggatttttaatttcatccaaatgcaagccgactgcaatcttggcagccatcttagcaattgggtaaccagtcgctttggaggctaacgctgatgagcgactgacccgcggatttacttcaatgatatagtaattaaaactattcggatcgagggccaactgaacgttacagcccccctcaatcttcaacgcccgaataatcttcaaagcagcatcccgtaataattgcacttcgcgatctgctaacgtttgaacaggtgcatagacgattgaatcaccggtatgaatccccacggggtcaaaattttccatattgcagacgaccatcgcattatccgcagcatcacgcataacttcaaactcaatttctttgtacccggcaatactttgttcgatcagaacttgggtcactggtgataacgccaacccattttcggtaatgtcgtgtaactgttggggcgtctcggcgatgccaccgccagtcccccccatcgtaaaggctggtcgcacgatgaccggataaccagcttgctcagcgaaagccaacgcttcgtcaaccgtccgcgcaataccagaagctggcacgggttcgcccaattcttccatcagtgccttaaactgttcccggtcttccgcctgatcaattgcgctgagcttcgttcctaacagttcaatgtgcaactcatcgagaatacccgatttagataattccatcgccatattcaagccctgctggccgcctaaagttggcaaaaccgcatccggatgttctttgcggagaatctgtgaaacaaattcaagtgtaattggttccaagtagacctggtccgcaatttctttgtccgtcataatcgttgcggggttagaattgaccaagaccacttcataatcgagttcttttaatgccaggcaagcttgtgtcccagaataatcaaattctgcggcctgaccaataataattggtcctgaaccaattaccataattttatgaatatctgtccgtttaggcattgaattggcttcctttctgggttgcttgattagccgccatcaaatcaataaattcgtcaaaaatatgatcagcatcgtgaggacccggcgctgcgtccggatgatattgcacggaaaaggccgcgtagtcacgatgccgcaagccttccacggtaccatcattaatctcctcatgggtgattaacaagtcagtctgcgctaatgaatcccgatccaccgcgtaaccatggttttgcgacgtaaaatcaatccgcccagttgcaatctcacgaacgggatggttaaacccacgatgtccgaacttcatcttgaacgtgtccgcaccgtttgctagcgcaaaaagttgatgtccgagacaaattccaaatagcggcacatgtttttccacttctctgatcatctctaaggctcccggaacatctttgggatcaccagggccgttcgtcaacatcacaccatccggattcaaagccatgatttcactcgccgtagtattgtacggcaacaccgtcaagttacattgacgctttgctagttcgcgtaaaatcgaatgcttcaacccaaagtcaacgacgaccacgttggggcctgtcgctgggttgggataggcgttattcgttgaactctgggcaacaacggcccgatttaatgccgtgactttgagccggtcaaccgtatctggtaagacgttatcgacgatggtggccttcatcgcgcccttcgttcggatatgtttagtgaccgcccgcgtatcaatatccataatgccaggaatcgcattctgttttagataatcgtccaacgactgagcattacgccaattactggctcgtcgggcaacttcgtgaacaacaacgcccttacaagttggcttgattgactcatggtcatcccgattaatgccgtaatttccaatcaaaggatacgtaaacatcaagatttcgccattataagactggtctgtgatcgactcttgataaccactcatgccggtattaaagactaattcaccaaccgtggccgttgtcgcaccaaaccccgtgccggggtaaatcgtaccatcttcaagtactaagtatcgtttcatgcttgcgttccctttccatatgccaacttaccgtcaactagtgtcattaagacgttgccataaacgggccaaccgataaacggggaattgtgccccttcgataacatggtggccgcttcgatttcatattgatgatctaaatcaataatggttagatcagccggtgcccccactaccaaccggccggctgtatttaagccaaatagttcagccggacgcgtgctcatcagttcaattaaacgaccgagcgtcagtaaccgggtcttgaccagcgccgtatatagcgtggcaaaggcagtctcaatcccagtaatcccgaaggctgccgtcttcatgctgccctgtttttcggcatcagtatgcggcgcatggtccgtcgcaatcatgtcgatcgtgccatccaacaatcccgcaactaacgctgcgcgatccttggctgaacgcaacggtggattcatctttaacatcgggttatccatcgtaatatcttcatcacaaaggagtaaatgatggggcgatacttcacaagtcacgttgatgccagctgctttcgcattgcgaatcacgcgtaaactttccgccgttgagacgtgacaaacatggtagtgaaccccactcgcttccgccaacatgacatcacgagccacttgggacgcttctgaaacattattgataccaggcaatcctagccgatcagcaacgggccccgcgttcatcacgccatgatgataaagcgaatcatcctcaacgtgtgccgctaatggcaacccaactttagcagcaccttgcatggctgcaaacatggttccggccgtttgaacaccggaaccatcgttactgacggcaaaggcccccgcagctttgatgccggcaaagtcaacgagctgttcactagtccgcccagtcgtaatgctggcatattgtgcgacgtgaacatgtgcttcctgctgattacgcgccaccatcgtcgcgacccgcttaggtgtatcgggtaccggatccacattaggcattgctccgaccgttgtgaaaccgccatgcgccgcggctaacgttccggtcgcaatcgtttccttcgctgtttgaccaggatcgcgtaaatggacgtgtacgtcgacaaatcccggactaacaaagtgctgatcggcacaaatgacgtgatccgccggtccaaactgatcgtgcagttgatgcccgatcgccttaattcggccctcggcaatcaggatatccgttgtttgtaactgccctgcttgccacacttgagcattcttaattaatgttgtcatgcgttaaacctccacttgagttgctgaaattaatccttgatgagcgaggacgctcgccaccattgccatccgaatataaacaccattcgtcatctgctgaaaaattcgtgattgcggcgcttcaactaagtcactcgctagctcaacacctcgattaacgggggccggatgcatgataatcgcatgcttgggcattcgtgcggcgcgctcagctgttaaaccatactgttgatggtaggcagacgcatcgaaggtctgattgttcacttgcgataatcgttcgtgttggacacgtaataacatcatgacgtccatcgttgcgactaactggtccatcgtctgatattcgccgtatgcttcaaagtcacggccataccattctttggggccgccaaagtaaacctgggctcctagttgcgtcagtaacgccatattggaacgggccacacgtgaatgggccaagtcacccacaatagctatctttaaaccatcaaaatgaccaaattcttcataaatagttagcatatccaacaacgattgtgacggatgttgcccactaccatcaccagcattgatcaaactcatgtcaaacccggcgtcgagaagtggttgataataacgatcgcgtggatgccgaaccactgccaagttgacgccaatggcttcaatcgttttcaaagtatccagcaagctttcgcccttagtcacggaactagtctttgggtcaaacgaaatcacctgtaatcctaatcgtcgttcggccatctcaaaacttgtatgtgtgcgggtgctattctcaaaaaataagttcatcgcaaacgttggctgtgacagttgtaccgttttcccattcttgaaagcttgggccaacttcaagtaggccatcacgtcctgattactaaattgttcaacactaactaggttttgactcgttttcatggctattgccgtctcctttgtatataaaaaaagtctagcttccgcaaaaatgtttgcaaagaggctagactccgattaagtggtcacgcatgaccaaaccgtttcgttcctctctggaaacaattaaatggttttattcaattaaatcattcttctaatttttcaatactaattccatcatgtccgtcgtgttcttcaagggcgacactgacttgttcatccaaggccgttggaatatttttaccaataaaatcaggccggatcggtaattcacgatgtccacgatcgactaagaccgctaacgaaatctttgcgggacgtccatggtccatcaaggcatctagcgcagcccgaactgtccggcctgtaaataagacatcatcgaccaagataacgtgtttgccattgatatcaaccggaatatcagcaccatttagcttcgcttgaccggcaacatcaaccgcatgatgatcatcccgatataacgtgatatctaacgaaccaactggcacgtcaacgccttccaactgtttcaatcgttgcgctaaccgttgggccaaaaaaatcccacgagtcttgataccgataaataccaggttaccaacacccttattctgctcaataatctcataagtgatccgcgtcagcgcgcggcgcatggtcattgcatcaacgacttctcgtgccattagtttgtcagctccatttctgtaatttcaccttaatccacggggtaaaaaaagagtcaccctgttttcctgcgaaaagcgtgggagaccctacatgaccgttccccttgttagcctcacaggactaagttaaaggtgcttgtttaattggactaagtgtaacgaactccaccacaactgtcaaggactaatcaacttaagtcgcgttaattatctgacgactttggtcatttgccctttatgttgacaagcatcattgaggaacctggcgagttcaatagatttccaatcgtgacacgtgatcgtcttattccggcctctaagaataaatgatgagcggtcgcctaatattagtaccattggtcgttgaatccgttgatattagaacttcaattaaagctgggagaccatcaattcactttaatgactgtttcaatcttaacgtgctaatttagcaacaaatggtctatcaaaatatcattatatgcgaaatctaccctttatgagcaacaacaaactcagcaaaagttaagtccacccatcacttgaacaccacctcgactgaaaggcgttgctgacaatactcagcactggaagccggtgaagttcagacgggttgaaactgaagattatctcaacggcaacgttgaggggtgaactttcacttagctaactggaagtctcaacccgagcgaaccccgtttctgtatgtcggcatccaacgccctaaccaggtgaatttacactaaacaaaactttcttcagcagtcctgcgccggctactcctgcgcttaaatgaggataaacctttccaatacttaaattccttaacccataacactggttcgacgcttcatttgtttttaatctgtttttcatttaattatagtcaaactgccaaattatcggtatactacttgttaaagataactaattttagggggacttaccatgcgtttacaaacactattacaaacaccatcaatgcaacatatgcgggtaattgcgggtgaacgcggtctcaaacgcgaaattagtaatatcggaatgatcgagtcacctgacattgctgactaccttgctaatggtcagtttttgattacgaacggctatcccttcgtcaatacaaccaccgacccactaactttgatcaaggcgatgcacaatgccaactgtgctggtctcggatttaaggatcatcgttacgttgaccatttaccaaaaaaagtgattgaattagcgaacgaactcgcttttccaatcattattacgcccggtgatgagttgatttctgaaaccatgcgcaaaatgctgagcatcatcttaaagtcacaaactaatgagctcagtcgcatcgtcaaggcaaaccaaacactagcggatttgttgctcaaagacccaacgaacaccacggtcttgaataaatgtagcgagctaattcatcatcctctcttcttaatggatagtcattttcgggtggtcagtgcttcccaagatttaccgatgacccgcaataccttgactgattttttacgcaatcaaaccgatatcgactatttcaacctcaatacccgcgtcattctcccttaccaagcaaatgacctgaccatcatgccactattttcggcttataaggaaaataaggcctttgtaggcgtcgtcgacttggacccggccaactcaactgatcagatgctgacgcaagtcgtcttaaacaccttgagtttcgtcaatggtcgggtggacatgttaaatgaatccgcattccgcaaccaaagtggtttctacttaaatgtaatggatggcggtatttcaaacgacctcgtgaataagactctgaaagcccgcaatattgatccgagtacgaagttccactgcgccaccattctagtcacgactaatcaccaggccctcttaagtaaccatctcttggaacaggttcagcaactgacactgtggtttattaaagaataccaagcatccgtcattgttttttcattaaagcagcaattggtcttattaatcaatgaccaacaaaatgcccagcacttcctgaccgccctcgttcaatttattcagccaaagttggacagacaggcgcgtttgattgctggctacagttattcgactctaccactaaccgaactcgcaacaacctataatgaagcggcagaagccttggcactcagcaaaaacagtccccacgcagtcacgatctatcggcccaagtacgtcaaggaactaatttcactgatcccacaaaatgaagcgcgatcgtttgtcgaacgggtcttaggtggactcgtcagtggtgtcagtgcgaatgaacaacttaatctactcacaaccctgtatggctatttttattaccatcaaaacattgccgaagtggccggccacctagatattcaccgcaatacggtgatttaccgccttaaaaagatcgaaaaaatgctaacgttgaacttggacgatcctgaacagacccaaacactagaaatggcagtgctactttggcataatcaacaatcacaaaagtgaacgttttcattttcatcttccaaaaaaatatcgttttcacgaacattaatttattcggctacatttgtattcggttttcatctgtgctagaataagtctcattcaaataagtggtaattgcctatataatgtcatgatatggttgacgagtttctacccaaccccgtaaaggttggactataagcaaacgaggtcatcccgtttgccggggtgactttttttataggcaaatcagcttaatcgagagaggaagattgatttgaaggaagtatccgcagcacctaaaattaccaatgttaaggcggccattttagggtttcaacatctgttagctatgtattcgggtgatgtgctcgtgccattattgattggcgcggccttgcatttcagccaagaacaattaacttacctagtctcaatcgacattttcatgtgtgggatcgcaacgttcctacaattaaaacgtacaccactaacaggaatcgggcttcccgtcgtgcttggctgtgccgttcaagccgtcaatccgttgattcaaatcggtaaaacatatgggctggggaccatgtatggctcaatcattggtgctggtatttttatttttctgattgccggcttattttcaaagatcaagaacctctttccaccagtcgttacgggatcgctaatcacaattattggattcacgctgattccggtcgccttccaaaatcttggtggcggcgacaccagtgccaaggatttcggtaacttgcaagcacttggcattggttttctcaccatcgcaattattttattaattagcgtgtttgcacgtggcttcatgaaatccgtttcgattctgattggtattttagttgggactttgattgccggggcaatggggatggtttctttaaaacccgtcgctgaagctagctggttccatttaccgaccctcttttactttgggaccccgcactttgaatggtcatccattttgaccatgatcctcgtctccttaacaacgatggttgaatcgaccggggtcttctttgcccttggcgacattaccggtcgtaaaattgaaggcgacgatttaaaacgtggttaccgggcagaaggaattgccgtcatcctcggtggcttgttcagtaccttcccctattcaacgttttctgaaaatgtcggcgtcgttcaattatctggtgtcaagacgcgaaagccaatttacttttccgctgcgttcttagttgtattgggcctactgcctaagattggtgcgctagcgacgattatccccgacccagtacttggtggcgccatggtcgtcatgttcgggatcgttggcattcaagggattcgaatgttagctcaagtcgatttccgcaataacaataatttactcgtggcagccgtttcgattggtcttggtttgggcgtcacggtgcaaaccaatatcttccaattcttacctggtgcacttcaaatcatgttgagcaacggggtggtcgttggtagtgtagccgcagttggccttaacttactcttcaaccgccacgcagccgaaaacacggttgatgatgaatcagtcggtctcaatgaaacagaacaaccttaattatgacgcttaaaagcagcggttcacagtcctaatctggcagtgaaccgctgtttttttgttctgctacttaatagccgctctcattctattgattgctttatactgccattttttgctgaatgtcaaccgtcgtaccggtgaagactttttttaaagtaactttctttcgacttggcataaaacttgcccatgctgccgaagagtcatctaaacctggtccattccaaaaacaagccatcgtgaggcaataaactgattaatcccctgttaccctaaaaatcagtatgttatactagacaattgttgaattgttagttttttattaattttaggagtgggtcattattctagaacaattatttcatttgcgtgaaaaccgcacttcagtccgccgcgagttgattggtggtctgacgacctttttagccatgtcatatattttagccgtaaatcccgaactattgggaagtactggtatgagtaagaccgccgtcttcaccgcaacgattttagcggccattgttggttgtctcttgatggggctagttgccaactttcccgtagcattagcaccggggatggggctgaatgccttctttacttatacagttgtccaggaatggcacattccttggcaaaccgctttggcgggagtctttgttgccggaattcttttcatcctactaacgctctccaagttacgcgataaactgatcaacttgattccaagtgcgctaaaatacgctgtatctgccggaattggcttgttcattgctttttcaggactacaaacctctgggattatcgttgcgaataagtccaacgcggtcgccctgggtaacttgcacagtcccaccgttttgttggcgattttcgggattatcgtcggcatcatgctagtcaccgctaatgtaactggtggtattttctggggcatgttcatcaccgccgcagtcggaatgatcttcggtattattcccctaccaactgggattatcagtggggttccgagcgttcaaccgatttttggtcaagctgtgacacaccttggtaatattaattcgtttcaaatgatcattgtcatcctgacgttcttcatcattggccttttcgatacgtcgggaaccttggttggggtggcaaccgaagccggcatggtggacaaagaatccggcgaagtcaaaggcgttggtaaagcgctctttagtggtgcactcgccacaactttaggagcagtctttggcacgtcaccgacgacggcttatgttgaatcgacttccggcgttgccgtgggggcccgtactgggttatcttccgtcttcgttgccctcttgtttgccatcgccgcctttttctctccaattttgacggtgattacgtccgcggtgaccgcttcagccctgattatcgttggtattttaatgttatcaaacgttcaatatattgattggaccaagtttgaaatcgccgtcccagcctttttcaccatgattatgatgctactaacttacagtatctcagaaggtttggccgttggctttatcttctacccaatcaccatgacggtcaaaggccgttggcgtgaagtaaacgccctcatgtggacgatgatggtcgtcttcattctctactttgcatttgtcgcttagaactgatggttcgctaagcaatgatggcagtctaaaacacccctgagtcgtttaactcaggggtgttttttagtaggcacggctgcatctaacgcctactagtgtttaagaacttgttgattatggtaatcttcagcgtagacttgggcaaagtcagcaagtttaacatcgcctaatcgaggttgatgtgctcgataatccgcgtaaaaatcgtggtcacgctggtaagcgaccgttttaacatattcccgtgcaaatgcgaccggggttccggcagtcactaaatgatcttgcatgacctcatcaggcacttgtgaaacgcgcaaatccggcattttaagagcctgtgacagtacggaagcaacttccaaataagttttctcatcactcgcaacatatgtcaccgtttgccccggtgtcggttcggtcagcgccttaatcagtacagttgtaacgtcgaccggcgcaacccacacgttcttaacagccaaattggcatttgtgtagattcgatgactctttttaacggttggcacactgctcagtaaattatagtacattgccgttgggcggataaacgttaagtccacgtctggtaaagcggttgttaacgtttgttcgataatatgatacatgtaaagtgcaccgacttctggtcccaagtcggcccccacgctactcagattcaccactcgttttacgccggctgccttgatcgcagcggcatagatatccgcttgtcgtttggcagcggtataaagatcatcactcgccgctataccagttaccatgaggtataccacgtcagcgcccatgaacgtcttggtcaaaaacgcttcgtcatcaagtcgaccaatggcaggggttgcgcgaaaaacctttatcaaactactgcgaattgcttgatgactgatgaccgtcacttcatgaccagcatgggtcagcttaggtaccaaggtctggttaatacgaccgattgaacccgttaaaacaattttcattttatgataaccctcttctatacttattaaaatatccgtcaaagtcattatcgattataagcgaccactaaaaccccgtcaatcactggtggtttagttggctaaacagtgttgatgtgcggttgcgcgattcgttcataagacaggactgattaacgctaatcaaaaattatttctatttatcaagagataatttttgttgaaactgtgcaaaattaggcctataatgtcaaaatgtttgacactgtcaactacgacggttagtcgcctttcctgttaccataagtttttcttacggagattatattagatgagtctagcacaattagaaataggattactgtggttgacaggctcaattgcggtcatcttcatcctgacgattggtacttactattggtactcccgcaaacgttccaacaattaccttgaaaatgatgattttaatctacgctactttattcaaaaacaagtcgattttcgtggccgcactaccggctatgaatgtctcctgcgtcaacaaaatactgatggttcgtggtcattaccaccacaacttgactcacttccacttcagcgggtgatcttcctgcttgaagatacctttaaggcgctacctgatgaagcgattacgttatcaatcaatttagaatacgaacaaatcatcagtcccgaattccgttattttgttcgctgggcaattgcgaacatcgaaccgatgcacttggcaattgagtacacacctcaataccaaccacgtcgtatcaataaacgcctatttcggcggcgaattcgtgaagcccgcggttacggcatgcagtttggaatcgataacgtcggtgcaagtctagccaatcttaaaaacattcagtggcttttaaaagatatcgacacgctcaaatgctcaatgcgctcatttcgcaaggaagacccatccgtctggctggacctgaacctccaattctggaatcagctctctaaggaaaacaatattgatctaattctaatgggaatcgaaaatgaggccgatgaacagctcgccgagcaactgcaaatcagcattcgccaaggctacttattcggccatccaatcaatccccagcaatcaaccacaaaggagaaccacgatgcctaaaccaaccactgatgatgttaatcggcaacaactatactctgatgcgtactttgacactggccattggggactcaagattcgccaaacgatcgttggtatcgtgggttggatcgcagtgattgtgcccatcaccgtgacagtcctttccatttggtcaagttataatccacacattccgcgtttctggcactaccatgaaggtcttttcgaatttaagttcatcggtatcttactggccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgccactaccgggtcaagccagaacaaaatctcgatactaatcagattcagcaactttatcaacaaaataatttagacgatattaacgattaaccagggggcgccatgacaaatatttttattgaccacatattcgccgcaaccttatttaaatcggtaatcaacatcgcactcctgattttatgcctctaccccatcgttggctcttttttctggttcgccggcgcgctatcctaccgctttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgactgacaagacggccaccattattcaacggttgcagtccgtctatccacggctacgaaccgttgaaattgagaaaaacaagggcaaggcccacgccttcaatattggcatgtactttgcccagggtgagtatattctcagcaacgacgctgatacgattccagaaaaggacgccctgatgaagtatatgaatttcttcatccatgaccgcgatatgaatacatccgccgtcaccgccaatatggatgttcaaaatcgaacgtcgcttttaggtaaatctcaaaccgttgaattctctagtatcgtcggtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaaacgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttacttcctgataaccggcaattttgaacgagtctaccacggcttgatgttgtcatttgtctttgttagttttgaactattggccgggttcatgcaactgttagcggcactcctgttggaccatcatggtgcgaaactaaagtactggttcttcgccccactctacatgttattttactggatgatcaatcctatcaccgtcgttgcaacgtttattcctgcactcaaaaccattctgggctttggctccggaacgtgggtcagcccgaagcgacagtcattgcagggtaaaaagtaaaacggtgtcgctattaacgctttcaataatcgataacgggtctactggtgcgagaacttgcaaccagcccaaccaaaaacgtgcacttacctgagtgataactgactcaggtaagtgcacgttttaatattaatcccttttgatcgttttcttagctatgcaaacggagctgcccaggccaccctgtgactagctacgctgagtaacaggtcccatgtgtcacgtgccactgaacacagagatcggcaggtaaatcacgaacggcctcacgacttacctgtgtgccaagttcagtaattgatcgcccttgctgactgccgaggccctggcgattcagctgaatcgtccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaagatttgtttatccacagttccaccactgatttgattgcgcatgaattcaaaatgcgcaacggcaggatggttgaagccactgattttaccggtcaacgcgagcgccggtaccgaacctatctcggattgggtgatgccttgtagcccccagaaaaagttaaagtgccaccaatttagattatgcggcttatcaaccggtttccgaatatgatgcataaaagcagcgtcctccatccgtttaagtcccgccgcattaatattcagcgttgttgtgccccgatgcaaccctttttgagaccgcattaccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagatcaccgactctgagttggttgatttgttgataaacagcccgctgtgctgcgaccaagctcggggcacttgcggtaaccatcatcacccggccacccgcactgactaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcagtaagtcgacgatgacttgataaaaatcactctgtagttgtggtaataagatctgcgtttcaggatcacccagtcgcaaattatattcaataacttgaacaccggtcgcagtcaggattcccccaacatagatgaccccttcaaagcttaacccatcggttttgagacctgcaatcgtcggttcaataattgtcgcaatcgtttgatcgataaccgcgggcgtgatttgcggtactggtgaataggcccccataccacccgtgttcggtccccggtcatggtcctgtaaccgtttatgatcttgggcggtcggtaataacgcatagtgctcaccaccaaccaaaaccatttgggaaaactcaaagccagcaacgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcaaataccttagaactttccaactgtgccgcagcttggttggggccaaagatagccaggccggctgcttgaaagtaatcaacaatgcccacggctagcggtacttcgggtccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccaccaccaccaactactaatacgtttgccatgcacgcacccatcctttcattaatgccggaagtgtcgaacaccagtggtgaccatcgcaataccataacggtcggccatggcaatcgaatccttatcacgaatactaccacctggttgcacgattgcacgaatgccgtgctgcgcagcatattcgacgcaatcatccattgggaagaacgcatccgaagctaggatagcattttcgtagccagcttgttgcatcgccttaccaatggcaatcttagttgaatcgattcgattcatctgaccagaaccgattcccaatgtccgatctgcggtagttacaacgaccgcattgctcttaacgtgcttcacaacttgttggccgaaagcgagtgcttttagctgcgcaggtgtcggttgggttacggtaactacggtaaaatcagctggcgtttcgaaggccgcgtcgacctcctgacgtagtaagcccccaccgactgaaatcgtttcaaacttatcggccgtgtgcgtttgctcaaagtcaaccgtcatcaagcgcagattcttcttcttggccaaaatagcaaaggcatcgtcatcaaaactcggggcaataataatttccaagaagagtgcgtgcatcttctcagccgttgcgagatcgactggtcgatttaaggcaatgattcccccaaagattgaaatcgaatcggcttcataggctttgtcccaagcagcctcaatcgtcgtacccaagccaaccccacacggattcatatgcttcattgcaactacggccggctgttgatattcactgaccatccgcaaggcagcatccgcatccttgatgttattgtaagaaagctctttcccatgaatttgcttggcacccgtaatcgagaagtgcgtcggtaaagcattttcgtaaaaggcagccttttgatggctattttcaccataacgcagggcctgcttcttatcataagtaagggtcaacttttctggaaattcttcagtcgttaaatattgggcaatcaaggcatcataggccgcagtatgttgaaaaactttggccgctaaccgttgacggagtgccggtgtgaccgcgtccgtctgcaaatcagccagaatctgctcataatcagcaggatcaacaattggcagtaccgcggcaaagttcttagctgcggaacgcagcatcgacggaccaccaatatcgatttgttcaatagcttcagcttgtgtgacgtctggttgttgaatggtcgctttgaatgggtacaggttaaccacgaccatgtcaatcggttgaataccagcttcttttagttgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccaatgcctttttggtcccacccgttgaaatcaattcatagtcaagggcaacgaggcccttcgcaaaatcagttaatccctgcttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatggtaacgcccgtctcagtcacaccagcggcaaaagcatcctcgatgccgtgacgaccaggaaactttggtaacaatgctgggtgaatattgatgattttatgagcatacgcattcaagagggtcggaccaataatgcgcatgtacccggccaataataccagttcaatttgccgtgcttgcaaggccgtcaaaatgattgcttccgcggccgctttattcgcataatcatgaaaatcaacaattaatatcggtacgttagctgcccgggccttgtcaattaccggcgctgtcggctgatcacacacaagtaacccaatcactaccggtaattgtcgttcaataatcgcttggtggagtgcaacaaagttggtgccgttacccgaagcaaatactgcaattttattaggcatgctcagcctcctcaaaaacaacgggtgtcgtaccagtttggactgttccaactcgataataggactgagcgttggccgtcaaattagccgtcacagctgccacttggtcggagtgaacgatcagaaccattcccaagcccaagttaaaggtcgaccgaagatccatagcagtcagcccaccgagttcggccaataacgtcataatcggcggtgccggccattgacccaattcaaggtgcgcactcaagcccgccggtaacgctctggcgacgttctcaatcaagccgcccccggtaatgtgggcgatactcgtcactaatttctgctgtaataatggttgaactgcatcaacgtaaatggtcgttggtcgtaaaagttccgtttgtaaatcatgaccaagttcgtcaaaaaccgtggtcaattggtagtcgtgttgtttgaataaaatatcacgaactagactaaacccattcgagtggaggccattagacggcaacccaatcaagacgtccccagcccgaacatttgccggtgataacaggtccgcgcggttcgcaattccgaccgcaaaaccagcgaggtcgtaatggtcctgaccatacatatcgggcatctccgcagtctcgccaccaatcaacgctgtatgggcctgctgacagcccgcgacgacgccagtcaaaatggctttgacccgtttctgatccgtatgtccaagacctaagtaatctaaaaagaactggggggtcgcgccttgtgccaaaatatcattcacacacattgcgaccaagtcaattccaatcgtggtatgttgatcagcagcgattgcgactaagagcttagtccccacaccatccgtccccgctactaacacgggatcgttggcagttgcatccggactaagtggaaacgcccccccaaacgcgcctaattgctgattgccactcatttgtttgaccgtctttaagacgtcgtaaccagcgttgatatcaacgccagcccgcttatacgcatcgctcacttgatcaccccttcatgattggcttgtaattgcgcaatttccgcatcatactcggcttggtaatcatacagggccgttggataatccccattaaagtaggccatacatagtccaccatacggttcagtggttgacaagccaactgcatcaacgacgccctgttcactgagaaaaccaagtgagtccgcaccaaacgtctgacacatctccggaatcgtttgctgagccgcaatcaattcattagtcgattgaatatcgataccgtaaaaacatggatagcgtaatggtggcgatgcaattcgtaaatgaactgactttgcacccgcatctttcaataatttgacgatccgccgactggtggtaccacgtacaatcgaatcatcgattaagacgactcgtttaccagcgacaacacctttgactgctgaaagcttcatccgaaccccctgttctcgtaatgcttgggtcggctgaataaaggtccgtgacgaatattgatttttaattaatcccatctcgtaaggcaggccactcgcttccgcatagccggtcgccgctgataaagatgaattgggtaccccgacaacaatgtcggcgtccacgggctgttcaacagcgagctgagcacccattcgtttacgtgcagaatggacgttgacgccgtgaatatcagaatctggacgtgcaaagtagataaactccattgaacaaatcgccaactgtgtatcagtcgtataatggtcgatcgtcaaaccatgatcatcgatcgttaacaattctcccggctgaacatcttgaacaaacgtcgcaccaatcgtatcaagcgcgcaagtttcactacaaacgacgtacccgcccgtgggtaactgaccgacgactaatggtcgtaacccgttaggatccaaagcggcaatcaaacaatcattcgttagtagtaagtaagcaaagcctccgtggacttgacgtaaagcatccttaacctgttccgttaacgttgctgcggggctgcgtcgaatcagatgcattaaaatctcactatcagaactagcatgaaaaatggcaccatgctgttccaaccgtcgccgcagtgtcaccgcattcgtcaaattgccgttatgtgcgagtgcaaactgtgagtcgctaaaattaaaactcaagggttgaatgttttccaatccatgattaccagccgtggcataacgtacatggccgactgcagcttgacccgtcaaacgtgccaaccgccgtgggtcccgaaagacatcagccaacaaccctagtccgcgttccgtctgcagtttgccgtgatcattcgccgtgataccggctccttcttgcccccggtgttgtaacgcatggagcccaaagtacgttaattgggcggcgtccggcgagccccaaaccccaaagacgccacattcttcattcagacctcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttccgcaaagaagttggcagcgggcaagtcactggccagttccaccccgatattttgtggaaaacatgattcggcaatcgtcgtaatcaagccaccttcagaaacatcgtgggcactagcaactagtcctttttgaatcgcagttaacaatagacgctgattacgattttcagtcacaaggtcaaaatcaaacagctcgccactgatcgttcccgtcaacatcttttgcagctcactaccattgaaatcggcttctgtggtacctaacacgtagactgcatcgccagcgtgtttaaaatcgctagtcgtaatatctttctgatgcttaattaacccgaccatcccaatcattggggtgggatagatggcttccccgttcgattcattgttcaacgagacattgccagaaatcacgggcgtattgaataattggcatgcacgagcgatgcccatcgccgattcgtccaaatcgtaaaattgttcaggtttctctggattaccatagttcaagcaatcagtgatgcctaaaggttgcccaccggaagcgacaatgtttcgagcagcttccgcaacggcgatttccccaccgacacgggggtttaagtataagtatcgcccgttaacatcggtggtgaccgccaacgccttatccgtatgtcgaatccgtatgacccccgcatcggaacccggcttgacgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgttcatgaataacctcgagacacgcctccatcaataatttttccataaagggatcaccaacttgaaccgcggaacgctgggtttcattggcgtcattaaattcagcagaggcaaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgaatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccaaaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattccgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtggcctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgggcaatcgcaccactccgtaaataatcaccgtacgaaaagccaccaggtaacaccaccgcgtcataacctgctaatgaggtcgctgtcgccggaatcaaatcagccgtaacgtgtaaaatatcgcgcaaggcattcaccatgtcatgatcacaattagaaccaggaaagactggtacggcaaatttcatcattacaaagcctccatctcagtaatttcgtaacgataagtttccatattaacgttggctaacaagcgatcacacatctcgtcgatttcagcggcaactggccgatcatccgcgtgaattttcacctcaaaatacttacctaattcaacggcatcgacattcgtatatccaagtcggtgtaaggcatcatgaatcgcctcacccttggggtctagaattgattgcttataagtcacatagattttaactaagtacatgttaggcctcctcaacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccgtcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttggttaagtgtggcacggcaaatttacgctcaaaactacccgaagccgcattccgaacaactgtctccaagggaatcatggtcacgcgacggacaagttgcacatagtctgaaggttgctcaataaaatggttggcaatgccgtgattggctaagtctttgaaaatcaaactcgcgatgcgattattcaatcggcctttctggtcaatgggaaccttccgcttaccatttagcgctgttgcttgatctaagtattcgacccatagaatttcaggatcattagtggcatacatcgctttcgctttacccgtgtaaagcaaagcttgtttctcaatcgctgccgtcattattattgttcccctttcaaatttgccaccgacgctaatgctgcgtcaatatcgtgatttaatacggtgatatgacccatcttgcgctggggcttaatggccgccttaccgtagtcgtgaaaatgccattctgggtgttcaaccaactgttgacgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccgcgtagttccagagattcagcaatcgaaaccgcaattttgcgggccgcactatgaacactgggctgaacattagctggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataaggcactagcggcttttgtcaccactgctgtgtctagatccgtttgtccgtgaccatcgtagccacctgccgccgttttgagaattgccggcgtaccaacacggttgagggcgtaatttaatgactgtaaatccgtcaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcaaactcgtaggtcaagacatcactacggcgcgctagatcaagtaaagccgcctgatcatcataagccgcaacaatctgaaaatctgcgacctgggctgccggtgctttgggtgtcgggtcaaggacacctacccgatagcccatcgccttcgcgctaagcgtcatcatctgaccgagttgaccgccaccaacgattccgatcgttgcgggtggtaagagtgcttccttaaaattggcgttcactttgttcagcctcctgacgttgacgagcacgaaattctccaattgcatgttgtacttgtggttcccgtaaaccgataatttgggcggccattagcgcaccattcttagcccccgcatcaccaatcgccatcgtcgccacgggtacgccagctggcatctgtacgattgacaataacgaatcaactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaatcaggcgggacgctgtcaacgaatttcttgactttatctattaattaacgttttaatgttcgtgttaattaaattgataattagattaatgctacctcaacatgtacgaattacctcactgtttgcaggttttcggtgtctgaaaaaggttatcaactgatttcaagcgactatcttgataatattattaatattgaaatttccgaacaatccgtcatcatctaagtttcaccataacaaacttactgctaccattatcaacaactatccgttgaaacgggccattaacttttgtcggtgcgcaccaacaattgacagcaatgactgggaatcggcgtaggacgagcaactaagcatgtttatgctaactcagactatttatagcggggctaaactgactgccgctgaacttaaaaacaatcaacaacttaatttgcgaacgctttcctaaaggatcggattgaagtgaccaaaataacgcaaaaaaagtctcaaggaagcgattcctcgagacttttttaaggtactaattattttgctgaagcgccggaaacactatcgacatcaggcgcttcaggcttggttggtgcttctggtgcggcttccgtatcggctgaagcgccggagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttgataatagtgcatcacatacttattagggataccaggtaccggtaacttgaagagatcagtctcaccggttcgtagcatgtgtaccgctcgcttaacaccaggtacggcccgctttggatgacagtcagctagtggattaccggcttgagcaggtgtccgtgaagctaacatcttgtcgccatccatttgatggttatagtataaaaattggttgttggcatcggcatacgtcaattccattggcatcgagttgaggaaccaatttaattggttgacggtcagcacaccccgatcgagcttaacgtagtcgtcaccctcagccgcatgggtcttagcagccgcttgttcgacccaatcagccgcatgcatgttgacgcccttgattgtcgtttcaacttcgcccttagcctcaaggtcttcattcttccaatcatcagcgtgtgcttccgcatccatcgcgttgaccatcttgacaaacttcagaaacttgcctaacgtttcttgtaagaacgagacagtccgagcatccttcagattgttttggtcatcgaaagcctgcttaacttcgccgagcaaaaattcattaccaggcatgaccacagcatcaacacccggtgactctaaaatctggcgtagattcaactgtgcccgcgacgaaccttgatcatagtaagaagcgccaacgatcaatacgggtttccctgacatcgggtgaattttaaacgacaaccattcgatcacgcttttaagtgcagcagtaattgtatgattatgttcaggtgtcgcaataatgaccccgtccgcctgcatgatctttcgtttcaaatattgaacggcttcaccttctgtttgatcatcactctgattaaacattggtacaccttgaatatccaaaatttcaatatcaaccatgtcactaaaatgattagcaataaactttaacagtaaccgattataagacttatcttcaattgaacccgcaattccaactaatttcatcgtcgtcgccctctctataatttttcccaatccatttcacgaacttcttcatacgtcgtcgcgttggcattctttaattttttcgtgatttcgacaaagacttggaaatccttgaacaacccatcgagcttcgtcgctttctgttggtccgttaaatttccctggtcatcaaaggcttgcaatgaatgaccaagcataaattctgaacttggcatgatccgcgcccgtaattctggtgaatccaaaacttgccgcagatgtgcttgagcccgtgatgtgccgagtgccccgtatgaggccccaataatcatgacgggtttgtccacgaagggctggatatggaatgataaccattcgagagcattcagtaatgccgcgggagccgaatgatcatactctggtgtactaataatcacaccatcagcttgttcgatcttatccgccattgcttgcgcctgtgccggaatttcatgattttcgggcttattgaagattggtagacccttgatttccattaattcaatctctgcttgatccgcatagtgggactgcatatattgcaacaacttacggttggtcgactcatctgaattggttccaaccatcgcgataaatttgtgcattgagaacaactccttctatgatcaaatagtcaaatattatataatttcttagtcaataactatattgtagtggatttcactaaagaaagcaaaacaattttaagcgctttcagttttgctatgcaaacaactgaactcactgatattaggcttatccgtgcaatcaagtaaattcagtatccgcgcaacgttgccgtaattatatctgcttaacaaattttttcacaaagctacgacgctacgatcaaatcaatcaaatccgccggggcaattcgaccaaagtaatgggttaagtccaacggtgctagcgccgtcataatcgcctgccattcatatttcacaccagtcaaccgtgcaacgacgggagcaatcggttctgcaccgaagaaatcgccataaatcgtaactgcttcgatgcgccctgccaccacgtttaactgaaactcgacggtcccagcatcaaaatgccggcgctgcttaactgtaaacgctggtgactgaccgtaaatccaatcccagttggtaaaatattgttggttcagtgctgctacccctgccagtgccgtttcatctaactgatacgtcttagcttgactcaaatcagccacgcccaggatttcacgggccaacgtatcgcgaaattcctcaatcgtcaagtgctgataagccggcgccatgtacggtttcaagttcgtgactcgacttcggaccgacttgatacccttagaggccaacttatcggtcggcaccgtaagagctttcgcaatttgcgtctggtcgacatcatacatcagcgttccatgggagaacatccggccattctcaacgtgcatggcatttcctgagaacttcttgccatcaatcaataaatcattgcggccactcatcgtcgcaccagtggcccccatcgcgtgtaaagcctttagaactggtgctgtgaaccgcttaaagttaccaaaaccgtccccgtcgtccttagtaataaaactaaaactgacatttccaaggtcatcataaaccgctccaccaccagaagttcgccgcgtcaatgtaatgtggtgtgcgtcaacatagtcctggttaatctctgccttgacattttggtaacggccaacaatgatgcagggggcgttaatgtaaaagtatagaatcggttccgtcaaatcggcatgttccatcaagtaagtctcaatggcaagattcgtgcgaatatcatggctggagcttgcaagatagcgcatcgtcacacttcctattctaaataaatccgttgcaaatcattgatttcattgttagttaatttaagctcagtgtgtaaatagtggtttaaattacccgattgtcgtttaatttcggtcatagcggcgtccaaataagccgcatcaactgaccagagggcccgaatactttcgaccgttgcatctgatgcgccctgagcacgtgcttcggccatcgcaccattgatccggccaatcgaagcctgattagttaagagataatcctgcttgatcgtttcaaaatcgactccgagtgcggttaacaggtataccgcccccattccggtccgatcttttcccgcagtgcagtgaaatagtaacgtcgaatcgggttgatcatttgcaagtagattatcaaagaaccggcgatactcgtccttggcatgttgctcgtcggccaccatctgatagacctttagcatgtgcttgaatccactatctggatgcttctccaagttagccgtcatcttgtcagtaccgtcagaattccgcgtttcgtccacattgaacactggtgcgtacacgtacttagcattggcaggaattcgatctggcgcatctaagacttcttgtggtgaacgaaagtcaatatcgtagcggacgccataatcatccagcaaagcttggccggctgacgttaattgatcaagcccaccagtccgaatgaccttatgccacttgatttttcgaccgtctttagtcgagtaaccaccgagttcacggaaattaatgccacctggtacagttaatacacgttgatttgtcatttttgaaaccacctatctgttaacttttcattttctattctaacattatcggtcagtttaacggtgccccaatcaccgaatcagtcgctttatttccaagataattcgttagcaccatcgacaccaaccgacatcaacgcgtgctataatgtaagttacatagccagcgacggcccgtcaaatccagaacacgtttgctgacaaacagcatcacaaccttggaccgattagccataaatttccatactggcactaaataaaaaatattcactgaataatataacggaggatctttcgatgacatttgattatgcacaccaaactgattggcccatgactagtggtcaacatcagtcaccaatcgatattcaaacacaacacgttcagtcttcacagctatccgccatcaactggcgaggcttgtaccaagccaaaacgattacgggcgaagcgacgactttgaaggctagtggaattggtgccgcttatttgaacgaccgcgactttgcctttcaacagattcactttcatacgccggcagaacacttaatcgatgggcaagccgcaccaatcgaatggcatctcgttcatcaaagtgctaccggccagctcgccgtcgtcgccgtttttggacggattggcaagcctaattctagtttacaaggcttacttgaccagttcacagcccaaacgagccatgaactgacaacaccggtcaacttaactgagctcctcccagataccgggacggtctatcactacttgggctcattgacgacgccgccactaagtgaaaccgttgaatggtatgtctgtgccgatactgtcatgattggtgaacaacaattagctgcttatcagcaattatttgccgctaataaccgcaagattcaaccgttaaacgatcggccaatcattgccgaacgtttctaaataattttaatggggtgagctgatgcctaagaaagtaatctggggcttgattgcaagtggcctatttcttttattgatcgtcggtctcggactgacaacacaaatccatcaagataaagtcagtcacgtgattactgcgcaaaaacggccattgatcatgattggaggtagtagcagcacgcggactgactttgatgacatcgtccgttcacttaatgagcaacagcaccatccgctcatcaccctgactgttaaggcgaaccaaaaattggcgtttaaagaaaaacgcgtcgagaacaccaaccttaacgatgccctcatcgtgatctttttcgaagatagcacggactcaacagagaacattatgacccaaacgaacggcttagccaaagctattcgttatttgcaacgtcaccaacatctcaccacggccaacgcactcggttattcaaatggtggcctgatctggagtcgctatctagcaggtttgagctcgtccaaaccattagcagtccacgatttgatgttgattggcaccccattcttgggtactgatgctgcacatcctgataagacgctctatacatcacttcttgatcacaagaaccaattcaagaaattgcatgcggtcatcaacattgccggtgacactggcgagggtaacgacgatatcgtaccgctcagcagtgtgaacgctggtggcaacttatttatgaacaatgttacccgctacaccgccatgactgttaaccaaaaatcaattagtcacggtgacctgcttcacgaagcatatgttgcccggctcattcgtcaaaatctgatcaatcaataatatttttagctttagctgataaaaaactgagccacccttcatgatgatgaagggatggctcagtttttttatgattgattgtccgctatgactactggcgatcaaactatccaacaatttagtgtcacgagtagcccacacacgggttgcacagggctcaaaggggcgccacgtcgattatgaattggcagtcgctacaaatcgagctagctcatcggtcgacataccggcactgacacccaccagtaacttaatccgggctttttgtccattcaatccctgacaaaaaatcacacccatttgtttcaattgaacaccgccaccttcataagcatagacatcctgagcgataccgttgaagcaccgggaaaccagtacaaccggaatctgcatgtctaataatttttgcacagctggtaacgtcgccggtggcaaattccccgctcccaatgcttcaatgactacgccatgagtcgtgggttgtgcaatggcgtcaaatagttctggtcccatcccggcatatgctttgatcagaaaaacattatccgtgaccgtttgaatcgggcaaaccgttgatcgtagtaatgattcaaaaaagacaatgcctttattagcgactaacccaatcgggccaaaagtcggtgttctaaaagtggccacgttggtcgtatgcgtcttagtgacgtagcgggccgagtggatttcatcattcataaccactaaaacacctttttcggccgcatccggtgtactagccgtttgaatcgccgtttcgagattatgcagaccatccgacccaatctcattggcggaccgcattgcgccggtaatcacaacggggagctcattcggtaaagtaagatctagaaaatacgccgtttcttctagcgtatccgtaccgtgagtcacaaccaccccatcgaccccttcgtgtgcggccttatcgatccgttgctttaactgcaacatccgtgccggggtgatgtgcggcgacggcacgttaaagacgtcctcagtctctaactcaatatccgtgccaaatgaactctgataattgtctaaaggattttcatctccgggggtcacattgccggattcatcggccgacatcgcaatggtgccaccagtgtgtaataccaaaatcttcttcaagaatactcctcctcatcttttcacgtgcctacgcacatctaacagtaaaattattttaggcttgccatcgcctgattgcaatccaccctcactggttcttcatgacaacttccttagattctcatacaagtgatatcaactaaaaaaactagcaaccattcaaacaatttacaaaacctagcaaccagatcagtacgttttattagcctacatagtgctagtcactcaattagttcacttatcaactagttcgttaatcggttcgtcggttagttaccccttcaggacgaagtcactaacctcagtgcaccttattactcaatttcagtctcagggctaaccgattgactactcgctagacgttgataaatcagcgtttgacgtcccaatgactatcaagcgagaaaataatgattgacactcgcgttagttgcctttatagttagttgcataagtgattaaccaaataacaaaccaactaacttaagagaggtatttaaaatgacaaccacaccaatcatgaccgtcagcgacctgcacaaaacgtatggtaaggcgggcagcaaacaatacgaagcgttaaaaggcattaatttcaatgtgcaaccaggggaatttgtcggaatcatgggcgcatctggttcagggaaaaccaccttgctcaatatgctggccacactggaccaaccaactagcggtgaagtgactattcatcaacaaccgattacacatctgaaaggcaatcaacttgctgatttccgggccaaagagattgggtttatcttccaagatttcaacttattagaaactatgactgcttacgagaatatcgccctaccattgtcgctgcaaaatacgccagtcaaaaagatcaaaccagctgtcgaaaaagtcgcacaccaattgggaattgaagaattcctatcaaactatcctaatgaattatctggtggtcaaaagcaacgtgtggcagccgcacgagccttaatcaatgaccccgctattctatttggtgatgaaccaactggtgcccttgattctaagtcagcgcgtgaattactcgacctgttcaccaaaatcaaccaagaacgggctgtctctatcttgctggtgacccatgacccattttcagctagcttctgtcaacgaatcttattcatcaaagatggccggattgggcaagaacttaaacgtggggatttaagccgcagtgatttttatcaacaagtcctcgacaacctagggacgtttgaacagtaagccgaaacagtaaaaggagtcctttaaactatgttaactaaacttgccatgaccggcttcaaacaccgttggcgcgactacctcgttctcttttcaggactgatcatgtctagcgcaatcttctatatgtttgaagcactggccactaaccaagatttcttaaaacaaaatacgagtattagtatggtcggcctcatcttccaatttggttccgtactactcacaatcatcacattagtctacattggctatgctaactcattcttattaagtatgcgtaagcgagactacgggctcttcatgctcgttggtgcacgcaaaagtaagattggtcaattaatttggctggaaacactacttgtcggtatcactgcaaccattgtcggcattcttgtgggaacagccttaactgtcggcgtaagccagattctgattaacagtctaggcctgacgcttcaccattttacagcctggtacacgccagctgccattgcgacactgttactctacgttggattgttcttaattgccggtttattcaacctgctatccctgaccaagacaccagccttgaaattactacacagtaatgatcaacctaaccggccacaactaaaaccagcccgtcaactcatcgaaattgtcgtcggtgtcatttcaattgcaattggttactggtcaatggctaacctgaaaattttgcaactgatgggaattggaattgcgctcgtcacaattgttcttggaacttatctgctgtttaacgctatttttgtctggttaatggtcgcactcaaacgattctcatttgcccaacgtggtttgaatggcttcaccttatcacagctaagctttagaattcgtaattacactaagatgctgtcaattgtcgcaatgctattcgcactagctctcggcgcaattacagttggaatgggctttcacagtcaaattccatcaatggctaatattaataacgcttatgatatgggactggtcaacgctagtaccgctgaaaaagcacaaattgcagcgatgaagcccaagacaacggcgacctatcatttcaaagcaaccaagaaagtcgtttatttccaagctgctgaattcaatcggcaaccattcacgactattcatactcgcaataagaatcaactgacttttaataccgttcataataatgcggctaaattacaaaaatcagaagataattatcaactgatgcagcttcagagtggtgtcatggcaaccgcaacacccgtatttttatcaaaaacggcgtacgcgaaacttgcccagcctgaacagcgactaactgtgtttactaccaacaacgttatcgaacatcgcgttgcattgaacaaactggccaaacatcactttcacactaccagccctgaacaatttggaggtcgctatgcgatgtatctaatggttaacggcatgtactccgggctggaatttatgggtatgttcctcggaatcgcctttcttgcaatgctagctagttgcctgatgttcaagattctgtctggtgccgatgctgatcaacaccgttacaagatgctcgataaagttggaaccactagacgccagctcaacggtgccattaacaaagaaattgctgtgctctttattcttcctggaatcgttggtattgtacacgtcttgtttgggttacaaatgttcaaaatcataatggttacctcaccatataccggaatttggttaccattcttgatttttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggtgctcataccgcttctgtggctgagcgttaacttcggtttagccacccagattatctttgaacatcaatacattctactggccgtactgggcaccctcctcctactctctagttggattgctgcccggatcgatcgtaccgaacgacaactgcaccagccgcaacaaaaggccacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatcctgcgaccgtgcttaagggcatgaatattctagttgatgcccaattgattgaaaaacggcgtggggtcgggatgtttgtcatcgccggtgcacaacaacgaatcgttgaaaagcgccgggatcagttctacaccgactacgttaaaaaactagtcgctgaagcacaaaagctccacattacgcaagatgaattagctaaattaattgaacgggggttttccgaatcatgagtattcaagttcaggctgtccagcaggcctttcgcggtcaaaccgtcctggataatcttaacctaacgatcaagccaaacacgatttacggtttgctaggccgcaatggtgctggtaaaagtaccttgctgaacattatcagcaatcgtatctttgctgacagcggaacggtcaccatggacaacgaatccatgtgtgataacgaccgcacgttaggaaaggtttacttgatgagtgaagttaacctctattctgagcgttcccgggtcaaacaactgtttaaaaccaccgcactactctatggtgattttaatgacacttatgctaaaaaactagcacaaacctttggcctcgatttaaacgcgcgatttggcaagttatcgacgggttaccgaacaatttttaaactgattattgcgttatgtgtgccggctgaatacatctttttagatgaaccagtcctcggcctggatgctaatcaccgcgaaattttctatcaagaactgattgaaacctatagtgaccatccccgcacattcgtgatttcgactcatctcattgaagaaattacgaacttgattgaacatgtctttgtgctggaccatcatcatattattgttgatggtgatgtcaccgacatcctaggacaatcttacgcggtaactggcccacaaactgatgtcagcacttatacggatggtttaaatattatcggcaaggatcatcttggcggaatcacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgcttgtgcggtggccttcggcatattaccactgttcttcgcattcatcagtgacaatattagtcaatactcgccactgagcaacttcgccaatctcagtcttagcgccctatttttcatgataatcttcatcactggggcactcacttatgactactttaagctttttattcaaagcgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaaatcaggtctggctaaacattttagctagcttatgctttaactggattttctacattggcgttggccttaccggcatcgcttgtgggaccttactcgcgttatttggtaagtgggccaaaacgattttaatcattggcactcccatcattggcatgcttattatttggataatggtcatcattatgactcgcaatcaatcgaactataattacacggggcttgaaaacttcttgaaatttattattggttatcccagccgcggtgaagcgacaactggttactttaacccaaccatgccattcatcacaatgctggtaggttgcggtatcatcggtggtctcgcttatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcccgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttagcgactgcaactgctttatcaagcgcaatctcagcttgttgtgagccatcgaggggaactaaaatattcgaatattcttgtaccattgacgtcacgccctttccatctgttaattctattttaccatttatcagcgttggttgcgttatcatttatataaactaactaccagttatgcacagcagctcgccggctagcagtgtcgggtttacataatatttacaacaacgacatctgatatttacagttaccccttacaattggagttaatccacttgggggtgaatagtatgctttctttaggtattcgaccaggcctaatcgccagccatacaattgtaatcaacgatgccctttcatatcaaatcaggttaagcaaattgcctctcggacccgatgtctatcggctagacatccgtgcaaccactacactgggccgcttgaccgtgtcccacgcacgttaccataactttgccacggcccagcaagcctttaatcatcagcgccaccaacttgaatcgcactaaaaatatccaacacgtagccatttaattatgataggatggtacctagtaataatcagctaaagtgagggtattcatctgtgggacaacttatcaaacaactctggcaacgctatcaaagcgtcctttcctatttaatctttgggggcttaaccaccctaattaatattattgtttttggaattttcaaccaattctggccctactggatagccaatacgattgcctggctcatctcagtgctattcgcctatatcacgaataaaatttgggtatttgactcacaaacacctactttccgcgctgttttaattgaaatgacatcattcttcggattccgcctactcagttactttattgaccaggggattatggttgtcggtatttcggttctgcacggaaacgaccttatcgtcaaattaattgatcaaattattgtggtattactcaattggttcttcagtaaactatttattttcaaggatcgtggtcattaaagcgaaccaacttaaacatcaaaacaagcgtcgtaggaatgtccgaaaattcctgcgacgcttattttattcataataattaccgacccatcttttttctgatacttaacttagctactatttttagcaaccatatttttcacccaaactggcgttgcaccgtatgtaacgtcgctaactttgtgaccacatcatcaatattgaccccatcccaattataaaaaatatattggcgaccacagcgcatcttaatcaccaaatgacgtgctgatgaagcataaccattgcgaacttcggcctgatccgtcgtcaatgcatagtattgaatgtcatccgtatttaaagctaactctccaattcgtatcatgacttgttgactgacctcagtcggcggtcgaactgacaaacaagtcccatcatggtgctgataccgtaactctaccgcaactaaaccggccgcggttagctgcggtcgaaaataaaactccgcgccaatatgcaacgcacttgacggccaaactgcggttagccgaaatttaaaatgccggccatgaaaatcagtcaggatgccttggtcgtaatctggttgcattaccgtaatatgcccaatcatgacgattcactcccttcacttagttattgataatgtatcacgcttcacaagcatagttgtgtttaaaacccataatcagtcgtttttaccattttttattaaaatagtaattaaattatccttactcatgctaatatttgagttaaccaactttattgatcggaggtcccgttttgatgacatttacaaatcaagaaactgactatcttatgaacctactaaccaaccagttaatggccctactaagccgcgtcacgcgctggcagacgcacagtctgagtcaacaccaatatgaccaacaagtacacgaaacgctccaacccgaactgaccatgctcacgcaaaccactgctaaactccagggacaagcccgtgaccaaactcagctaggggccattcaaactggtttgaagaaacttcaagttgccaccacctatcagctaactgccgaccaacttgcacacgctaatgaacgccggctgaatcgccgataccgcgattaacttttacaacatcagcatatttaccaggagattcaaaactatttcgcaatccttaacagaaaattcaaatttcaatcacgagttagctactttttctcggtacaatggttttatcaactcatacaaccacttgactgaaggagggcttccatgttcttaattgtttactgtacgttcgctattgcagtttttttctggatattcggttacgttaaaaccgccgtcatcattggtatactggcactgagcttgattgcttactccttcattcgccgagagattactcgacgacgtttgctcaagcgacgcacggttaccaataaaagtcgttaaaaaaattccaacacgccggtgtcggaattttttggttatttttgcatttgtgataaacaagtgacgatccgctgagccgcctcacgcacattttgcggattagtcgctaagttcaagcgaacaaacccctgatcatcaggactaaaccactcaccaaagtcaactgcgagctgacattgatcttgaataaacgctttcgttgcagctggctgaacgtacgcgcgtaaatctagccacgtcaaatacgtcccctgcaaatcggctaaaaccaacttaggcgcgtgggcggcaaaggtggtgcataaataatgataattatcacggacgattgccaaaatctggtctaaccaggccgcgcccgattcataagccgtttggccggcaacctggcctaagacgctgatctcagtctggctgaagcgcccgatttgtgcatcatagcgttgtcgtaattttggattaggaattactagatgtgagttcaaaagcgccgccagattaaacgtcttagacggtgcattgacgacaatcacccggttactaaaccgcccattggctaccgttaacgccgatttgaacggatggttggtccgatcaatttctaaatcctggtgaatttcatctgaaataacaagcacatgatactgttcacataatgctaacagccgtgtctcttcatcttcagaccagatctgccccacaggattatgtggcgaacattgaatgaacaaccgcacctcgttcgccttaatttgctgttccacatcttcaaagtcaattgtatagtgaccacgatcattgcgtaactcagatgtgaccagctgacgatgattatcccgcaccgcgttgaaaaatggatagtacacgggcgtcagaatcaaaacgccatcacctggttgcgttaaaatattaacgagcgcgtacaacgaattgaccacgccactaccaaatcgaatccaatcgcgtttcaatgtcagaccatggcgtgcctgttcccaatcgataaaggcttgataataacgatcaggcgtaatggaataaccataaatgccatgcgccactcgttcttgtagtgcttgcgtaacttgttctggcactttgaattccatgtcagcgacccacattgccaacaaatcaggattgccataccgagcttgtagtgcgtcccacttcaatgaatccgtatgctggcgcgttgttgcgtacttcttaataaatgctgcttgttccatcttaaaggccttctttctcaacaaaaaaacttcgtccttaacttactaaggacgaagtttatactccgcggtaccacctattattacagtcttgctgtcgctcacgcaacgtactcgttacgttcaacccaattatcggtggtcaatccgggctaatagcatcaaccattagccaactccgagttcatcttcacaataagctgatggtcaaattacaccactactttgactcgctaggcatcaacttattgttactcttctcatcaacatttaatcttcacgttgcttctaagttacaacgtgaagattaaaaagtcaacaacgtctttaaaattgcgcttgctctaaaacctggtagccatcgattcgttggtcagcggtaggaaacgccccggtctgtaagaaacgcttggcctgcatgacccgcggcgaactattcgaccaatttaattgatcaagtggcactcgagcggcccccgccgacattgattcggtgtaatgcggtcgtttgagcaacaaatggccccccaccggttccagtaaataataaatattaattaacgttgctggcaattctaatgttgttaaggctggaatcgtaagctggacggtcccaagttgctttgaaataacagtttgtagtcctgtttgaagttgtgcaatctgactaacggcctcactcaacgtggcccgtgtcgtcactggtgcggttactaaatcataacggttcttgaacggcccggttaaggatttattaaggaccatggccgtcgaatcaccaatgataccacaaacaaatagtggactaattgctggttcgttaatcatcaatcttttccttctctcagtcatacgattaaatagataaattaattagcctataaaaatataacagttacattttaccttagaattatgataaggttcctaaaaaaagcatgcgaatatgaatatttaacaacttttaataattctatgaaaaaaaccgaatcttggctactaaaacgcacaaggttcgattactttttttgttatttagttagattgcacatcggtcgtattaataaatgactgggctggcacacgaattaaccaccgcgtcatggcttgatgccccacatggacacctaagccattccagaatgacggctgataagtggctgtcagcttcactgcgtaggctttttcgtgctgccggtcttctttaaccagctgcttttgtgaccacggaataccagcatccgccactttaacttgcgaaagattagtcaccacggtcgccttgttacttgaaacagtatatttcgcaccattaacccagtaattataaatatgcacgggtttttgggtcgtgcctcgatccaccgcgacatagtaggaaccattagttccaactcgcaaaaccagtggttcaacttgatacgttaccttaacgtccttagcatctgacaggtcgacctggtgattgaaagtcacgtatcccatgccaactagtaatccgagactaacgattaattcaacggtggtaatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctcttagtatggtgggtcttcaacaatcaagactggcagtactactggttatccagcaccgttaagacaaccaacctcttaggcatcgtcctaatctgctacgttgtcttgattgtcatcgaattcatccaaggccggggcatcaagcctgagacagctaaataatgattattttaaacgccaagcaagttgctaggcgttttttattgtcaaatgcggcaacaatcttgctcttcagtgtttgttacggtgataacatttgattaatcatgctgcatgcttcatcatgattaataaaaaaaacgattctcaaagacattgagaatcgtttttttataagcgactgtcctaatggcggctatcggtcttgaagatttcaactgggaaacacacagaacgctccaccagtcgacttgtgacactacttcacaactaagccacggttaattcaaagcctcccggtgccatctcatttgcggtaatacccgctgttaagattggcgatacaccacttactgttgagactgcctgtgcacctaaattaaagcggccttgaatcgtctgttcaacatccgtccgcgttaagattaagcagtgaccatcaatcgtccatgtcaattggctagttgctaaaaagtcggcctgttgccggcgaaacttgatcaaacgcgtgacaaattgtcgaacttgttgttcttgctcgtctggttgccagttcatgcaccgacgattgtcagggtcggcaccaccggccatggccacttccgttccataataaatacacgggctccccggcaatagcatcagtagcgtgagtgcagatttaaatttagttaactgaccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaagactcacctaataggtacacatcaggtttgattgcccgcaaggcaccacataacgctcgccagaaaccatggtcgacctcatcagcaacatcaaaacgccaagcgtcaatcccgaattgttcgatccaatatttggtcacatcaatcaagtaagcttgtaccgcggggttctgggtgttaactttcggcatcgctgctcccgtcgcaaaggtttcataattaagccgcttcgtcttcggatcacgtcccaccggccagccatgaatatgaaaccaatcagcaaaccgtgactgctcgccatttttaatcacatcttgccactgtggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaagtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttaacccatgccggtggcagctccgcatcactgacgtgcatatatggcatgtgaaaatagttgcccaccgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaacaaaatctccacttgggcaacatcgtcacgcgcagtttgtagtcgtacctgtagttgatgtgcggctaagacggctgtatcttcactttcagggcggtgcctaattccagctagttgcattgtaagatctccttttatgtaaacgattacattattaactagaccatttacgtcaattatcctcatgattttggtgaaaacgtccccgttcgcctcgattttagtgtatcatttagtcaaaatcagttgaaaggacgttatccatgaaaacactttatcgcagtacccgcgaaactgcaagtcacaccatgacgtcatcacaagccgtacttcaaggcctgacgccggatggtggtctctttgtgcccgtaacgctaccgaccgctaattttgacttcgaccagctcgccacgatgagctaccaagaagttgcttacgaggtccttaaactcttcttcacggattataccgctgatgaattacacgcctgcattgacgcggcttatggtgatcagtttgatgacccccaaattgcgccggtcaccaagcatggtcagcagtattaccttgaactttttcatggaccgaccattgcattcaaagacttggcccttcaaatcctaccgcatttgatgacaacggcagctaaaaagaaccatttacaagccgaagtcgttattttagcggccacctcgggcgatactggtaaagctgccatggccgggtttgccaatgttgatcagactcgcatcatcgtcttctatccaaaagatggtgtcagtgcaatccaaaaacagcagatggtgacccaaaccggagccaatactagtgttgttgcgatcaacggtaacttcgatgaggcccaaacaacggttaaaaaactgttaaacgaccaccaattacacgcggaattagccacccaccagttccaattctcaagcgctaattccatcaatattggtcgtttattcccacaagtggcctattatgtctacacctacgctcaacttatcaagcaggggcaaatcaagaacggtgatgagattaactttagtgttccaactgggaactttggggatattttagctggctactatgccaaacaactgggcacgcccattcataaactgatctgtgcttccaatcgcaataacgttctcaccgatttctttaataccgggacttatgataaaaaccgtgaattcttcttgacgagttcaccgtccatggacatcttagtctcaagtaacttggaacggctcctcttctacttgacaggatcagacgccacggcgactgctaaactaatgactgatttgcaaacgaccggccgttatacgattacaccggcaatgcgtgccaacttagctgatttttgggccggcttcgtgactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggcctagccgcagttgatcagttacatgagttgattcaaacgcccattccagcaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttactaacttctgagaagacgatttctccgcgaactgaagcagttctcaaacagctgcattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctaaccgccgccaaagttggcgtagcgatggcgaatgctattcctgcggtcaaggctgcaaccaccaatgccaccctgagtaatgacgaggacggggtcgccgttttcctagaaaattacttcaactgatcccaaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacatgagtcaccagcacatcgatcaccccatgctggatcacgtgcacttcgaaaatgtccggtttacggccagtcaatttgaacggcttgacttgaccgatgctgtctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgactgtcaagtttaacgaaaccagccttgaccaagtcgctttcaacgataccgccctcaaaaatattgacctaagtacctgtcaattcgagcgtctcgaacttgatactgccgcagcacgcggtatgatcgtcaatattgatcaggctgcttatttggctgctgctttaaacggcatcaaagttaaaccctgataccggtagaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaataacttggcaagggttgccagccgcaatcacgttagctggaatatcgtgggttaccacgctcccaccaccaataatcgtgttagcaccaatggtcactcctggtaatacggtgacgttagcggctagccaacaaccatcaccaattgtgattggtcgggcgatgcagccgcccctaattcgttcggttgcatcaaacaagtggttactcgtgtaaaggccgacttttggccccaacaagacctgactgccgatcgtaattggcgccccatctaacattacacaatcatagttggcataaaagttatcacctagatgaatgttccgtccaaattcaacgcgaaaattaggatttacaaatggcttgcgaccagctaaaacaaccaattgtcgcaataaagtttctttagtctctggatcagcagtcgcattgaccgcgttcgttgtcaacgtcgcttggtcacgcaacgccgttagttctgcatccgtatctcgatacggctgaccagtcgccatatacgcaaacttctcatctaaattcattccgcaccccacttctatcgaataaaattcaagtaccatgttattgcgcagattccttgtgctgaacgaatctggccattctttaataggtcaatcactttactgagcgggacaagttgcgtattcacgtattcgtccgcgtcaaaatgtcgttcgccatgttcttgcggatcaatgtgagtcaaaatcaagctgaccgtttcgtccgtaaaaccttccgacgagctaatttgcgtcataatttgtgattcatgggcaatgtagcccgtctcctcttgtaattcacgggccgcggccgttaacggatcttcccccgcattaatgaggccagcaggtaaactaatcgtctcggcattgcgaccgacccggtactctgaacctagcacgacttggtcatccgcggtgatggctaaaatcgtgacggcgttcccatgctgaatcaaatcgcgttttacttctaatccatcaggtgtttcaatcgtttgtttgaccaaatcaaaaatcggcccatgatacaccggtgtcgttgataggaccttaccgcgccggccaactttctcaaataaatctgccatacacattcactactccttaatctatctcaaatccggtacaccatccggcagcatcttacgaatgccacccgcggggtctggcacgtcaccttgatatcgcggtatcagatggagatgacaatgcattacggtttggcccgcagccgggtcaacgttaatgccaatattatagccatccggatgattgtgcgcatctaggtacgcttttgcttgggtcagtaaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagtccccttcctattttgctaaccaaccaccatcaattggaaccaccgtcccatgaatataatcagcgtcctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgatagccgtctaacttaccggccgtattgcacacgacggttggcttgccgagtacgttaactcccgatttaatcgccgcgacgagcgcattagtgtcggtcacatcagcaatttcatagcgcagggctgacgtcgttactagcgctgatggctgtggttgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatctgttggtgaccacatactataggcttcatcggccgttttgattaaaaagtacgggttcagcgggtcgccggtgaaagtggttgccgtctgtaattcgacgaacaattcggtcccttcccaaccagtccgaacagcgcgcttaccagcttttaattcaggtaaaatagcttcaaatgtcatcatgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgagaaggatgcggcgtacctcgatttagccgcaaaatatggctatcaacgggtattcacttcactgcttgaaatcaaaggggaccaagccgcagtggttgccaactttaaaaaagtgatcacttacgcgaaccaattaggcttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtccaaagggactcactatgttgacacgattatggattattcacctgaaaaagataacttactaggctcacataacttctacccacaacaatacactggtcttggttatgattattttgttcaggcttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctgatcgacgacgttttaattggtaacgcctacgcgagtgaagccgaactaaaagcggctgctgaagtgttctttagtccttacccactgctacacgtcgaaaccgttgctgatctatcggcagttgaagaaaaagtactctttgcgcaaccacagacttatcgcggtgatttttcagattacgtcattcgttcttctcagacccgggtcatctacaaagacgaagcctttcctgctcatcacctagatgccattcataccggtgatgtcttgatcgataacgatgagtttgggcaatacaaaggtgaattgcagattgcacgccaaaatcttgaaaatactggccgaatcaatgtggttggtcatattactaagagtgacttaccttgccttaacttgctacaaccatgggccgactttaaatttgtcgctgccaaatagtactcaacgaatggaggggtcgcattaatgacaactgattaccgtttaactagcgatgctgaccgcgaagctttctaccaactttaccaatacgcgttcaataatcacgatacccccgcgcggcggcgatttttcatggatcgctaccaacatggctggatctacggccgtcacgatcatggtcaactggttagtgggctatacagtctgccactagcagtcaactttcatggcgtcacctaccggatgaatggtattggcgatgtgatgagtgcgcctgaatatgccggtcagggtggcgcgggacagttgctaacgacggcgctgacagaaatggcggccaaccacgtgacgctgtcctaccttgcccccttcgcgtacggttactatcgtcgttttggctatgagcatgtcttcgaccacgcgcaccaagtcatggccgctccagacctaccacgtgtcaaaccgacggactggtctggtacgatcacccgctatggcaatgacgggctggcccaaatcaacgatttttatgcacgacaaccacaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgattggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgactttatcaagcgctatccgtttctcacggacatccaaccaattcgcctagcagtcagtgacgctaccctccctgctaatcaaggaatctggtcattgacgcggcacaacgggcaagtaacgctcaatcgggttagcgaccaattaactgggccggctgacattcagttaacgattcagcaattaaccactgcttgctttggcacccagagcttagcccgggcgtaccaacacggattaatcaccggtgatgtgaatgcgatcaaccgacttgacactagtctagtgaaagaacgaccagcacttattgactacttctaagtgcttaatttagataagcagcatgactgactcaaagtgggccgccagaataatcattctggcggcccacttttttaaatattcgtatttcccgttcaaacagtttttgtcacatatccagtatttttaacaataagattacagctaattcttgggacgtttcttttacggcaaatagtcattctcatcttagtctattcaaaaaagatgtttgaagatccgactagatctccaaacatctttttactggcattatcctggttaatcaccagcatcgtgcgtaaataaaactaacgaatattaattgattaccaatgtaatattaaccatgtcttgacattaattttcatacaaataacccgcatcccgtaaagctgccttgatggccgttaattgttctggggtctgataagcaaccgtatggctatggacgccatctgttaattctgataataaatggccttgcaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagctctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagttcatttatcataggtgtcaagacacctaaatcttaataacgggattgattagcaatgcgcaatttatctttattaaccgacttatacgaactctcaatggcaaatggatttcatcacaacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaatcactggaccacttgagcaagcgcaattacttgaaacgctcgtcttaaatatcgtcaatcatcaatcactgattgccactaaagctcgtcgactgagttatgctgcggcaggacgtccaattatggaattcggtgcgcgccgtgcgcaaggcccggacagcgcactttacggcacccgggcagccattattggtggcgccaatagtacttcaaacgttctcgctgcgaaactgtttgatattcccgttgctggtaccatggcccacagttggattgaagccttcccggatgaactaacggcgtttcgcaagtgggccgaacaatatcctgacaatagtgcgctactagtcgatacttatgatgtgcttaactctgggatccctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacctcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggttagtgccagtcgcgaaaaactaacgattcctggtgataagcaagtctatcgtctgtacgaaccaggaactcagcgggcctttgctgacttgattgcactagctaccgagacgatcgtcgatgcgaccagcctaaccgtcgtcaacagtgacccactcagtgtcgaccgccaacagcgactcacccattttgaagcccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaacaaacgaacacgcgtagcaacgactaaagccacttctgatcagcgttcaaatgaccgcttagtacagaagtggctttagtttataacaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcgatctggctaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcttctgaaaaatcactcgctaaaattggcacaatgtgcacggcaattggtgctaagatggcatcccgtaaggcagccttagtcttataccgccgatagaccgtcccctcagcaacgccggcccgttgtgcaatatcactagtactagtctggtcaaaacccttttcagcaaacaaatcgagacttgcctggaggatggcccgttgcttaggtgtaatcgtttcattctgacttagatcatgttgaaaataatcccgtatccgtggtcgttccatatcctcacaccttccgctaacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactcgccatgccatcgactggaatcaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaactaagtgaatcttgaagaccgtaattgcaaaaacaacggtcaggacagtctgaatgatggcaaagcccccataaccaattagatagcccataataatttcactccgtcgaattggagttgcaagtagccggcttagggttccagtagtgcgctcattcaaaagtgaaacgccagaaatcaagaacacaaagaagaagacaaagaaaccgagaaagattggcaaaaagttttcaaagaacgttgaatcactactaccataaatataatgactgctagtggtataggtcgtcgtttgtgattgactatttgttggcgccgcagcactcgctgtagcctgcctcaattgcttttgaattttagccgccgcagcagtattcccacttgcctgtgcttgggccaaggccgtctttagcttgctaaccgttgcctgtttttgcgccgcggtcaacttttgtagtgccacctgttgcgtttgcaacacctttttttgtgctttagtagccgtgaccaacgtttgaatttttaatttgaccagtccactttgcaaagaagctttgatcaatgacgtattggtcggattactattagaatacgtgatcgttaagttgccatctttttgcgtcaaatatccatccaaatcatgctgcttaatcatcgcttttgcctggttactactgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcgattgccaacgacaagcgccgtttcatcccacccgaatagccactgacccgcttgtctaattgggacgttaaatcaactaatccggctgcataatcaatcatctgcgctaactttatttttggaacgctcatcaattgcccaaaaaaggtcaggttttcacgggccgttagtgtctcatacaaagcgtcactttgggccatataccctacttgtgccattaccgccctattgggcatcaccgtatccatgactttaacagtgccactgtccacagcctccatccctaaaatactcttgatcaaggtggtcttcccagctcctgatggcccaatcaagccataaatcattccagccggcagtgtcaaatcaatctgattgagcacttgctgatgaccaaagtgcttgctgacctgcttggcgatgacataatccgttgccattttaataaccctctttctcgaagtgagtgtatactcactcacttactttatttccagcccatttgtcaccgcactgcaaacaaaaatgcgccaccccgttgttgggatgtcgcattttaattaaatatcagcactgatataagcgttagcaatgttttaacgattgttaatcttggtcagcaatttttgtcctagctcataatccaactgacgctccgattccggcatcatgtcgccgccagttgcccagacaatgtgggtgacgtctttgccagcaagcgtgggaaattgggccatgatgggggcgatcgcggtaaagccggctgcagcggatggttcgaccattacatcttcggtatcgacgagcttcgtcaaataacggtataaatcatcatcttcaaatgttgctgttccgagtaatagcgttcgcatcaccttgcccgccaatcgtgatggccggctaacggctaacccatcagcggcagtcaggccatctaaaccaatgtcttgaacagcaattttttcattcagcttggtcatcatccctaaggtcacggacggcacgtgggtcggttcacaaaagacgggataaatattagctcccataatcatcttgaggccaaaagcaacgccactaggactgccaccgaccccggccggtaaataaacgacaaccgggtgtgcagcatccatcttgataccttgtacttttaattgatgttgtaaccgtaccccagcaacagcgtacccgaggaataagtcacgtgaaccttcatcatcaacaaagtgcgtatggtcatccttggccgcggcggcacgggccaccggaatcacacttgaaaagtcggtatttagttcctcaacggtgacgccatttgcccgcagtttgtccttcttccactgacgagcatcgtgagacatataaacggtcgtcttaaatccaaacgttgcggccatgatgcccacactgagtgccaagtttcccgtcgatgcaacgatgacgccgtattgtgcaaataactcgtgatacttagccgttgccaagacactgtaatcatccatatacgttaaatccgtatgggccatggctacctgttcagcaaacttgagcacttcgtaaatcccaccacgtgacttgatcgaacccgaaatcggcaactgactatcagcttttaaataaagctgccccgccaatgactggtggttgagagcctcccatgctggtttcatctgctcaagtggtaacaatggtgactcaataatcccattcatagctgccgtttctggaaaagcaacggccaaaaatggtgcgaaacgttcccaacgtgcgaccgcgtcaaaaatatcggcccgcgttaacggcaggtccgcccgcttcccataatctgggttctgccaaacaattggtcgttttgctatcaattccttaatctgtgggtgttcttcaatcattaccgttgtatccatactttcaggtccttttcatttaattgcatcatattacgtatcgtgagttaaaattatcagttttcgatggccgtctacatacgttcagcctattccgaccttccgagactaggtaacatactgaaacgtcaccacgatcagcacaaatgccgataagtcgatataacacgcactgagccaacaagtctcccccaacccgaccctttcaaccgaacctaagttagtggcttttctctgaatctaacgattttcaatcacaactcatgttagataatatgacatcaccttcgtccatcatttaaccatatttgatacttagaaacaatctttaggcactgattaacaataattgttgattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatctttcttcgagcgctctagtgtcccgttaccttcatcgtccttgtcgacgtagataaaaccgtaacgtttcgacatctgaccagttccagctgagaccaaatcgatacacccccacggcgtatagccaatcaagtcgaccccatcttcggtgacggccttgatcatttcactgatatgagcgcgtaaatagtcaatccggtaaggatcatgaatactaccatcggcttcgactttgtcgcgggcacccaacccattctcaacaatcatcattggcttgtgatagcggtcttgtaaccaattcaaagaataccgcaaaccttctggatcgattggccagtcccattcgctcgtcttcaaatatggattatcaacggcttcggtcccgacaaagtggtaacttgggttatcatcctgagcggcgaccgtgttggaattatagtaactaaagccaatataatcaacggtgccttccttcaagacttggcggtcttcggccgtgatatcagggcggaaaccagtctgtttgaagtaagcttccatattatttggataatagccccatgactgtacgtctgcaaaccaataacgccgctgcatagccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaaagcttcagcgtcaggatcatcgggcttcaacactaaaccagaatccgtcgccatcaggaattggttcgtataagtcgtctgattattaatttcgttgaaggtcatccagtacttaaccttgttcttatagcgtttgaagaccgtttcagcgtagtgcacgaaaaagtcaatgactttccgcgaacgccagccaccatattccttaactaagtggtacggcatttcaaagtgggccagcgtgatcactggttcgataccatattgccggcaagtatcgaacatatcatcatagaacttcaaacccgcttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatcttcaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcaaatcaacaccatctaatacgaccgcttgttccatcgccaagatgtgatcacggaagtaactgatccggtagtcgtcatgtacactcccgtcggcttccttcttatcgtaagcaccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttccgccatcatcacatccgctggtttagctgttagtggatagattggacacatcgcgaccatacagccgatttgaaaatcaggattgattgcgtggcccgcttgcacagctagggcactcgctactaattcataatgagctgcttgatacatcgcctgttcccaattgtcatccttgctaagttgcaggccggaattttgtaacaatgggtgcggatcactccaagctgtttggttattgatttcgttgaaggtcatccaatacttgaccttatcctgatagcgcttgaagacggtcttcgcaaaatgaacaaagaagtcgatcatcttacggttgctgaaaccaccataaaccttcactaagtggtatggaatttcaaagtgtgacagggtcacaacgggttggatgccatgcgataataaatcatcgaataagtcatcgtaaaacttcaaaccagcttcgttaggctcgctctcatcaccattcgggaaaatccgggtccacgcgattgacgtccggaaacacttaaagcccatttcttcaaataatcgatcatcttctggatagcgatgataaaaatcattgccccagtgattaggatagatttcaccatctttgacgccatccgtgactttacggggaaccccgttacgtccggctgtcattacatcggcaatgctaacgcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcagctaaacgccgataaacgtctacaacttcaccagctaagtcgcggaaggtgatggcattcatgatgtgatcttgtgaatgtactaataacaatgacacgtgggtatgttccccttgtgcttccgccgttaacattgaggtttgtgaattgtgtgcttcggttagaaagttatctgcttcctttaacttggcatcagcggtttcaaagtcgccttccttagcagctttaattgcttcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccttgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcgtcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttgtacccacaaattattaaataacaacttaatattcgaaagaagtgaacaccatgtattgtgacattgcaaccaaactcgttgccgccattcaagacggcatttttaccgtcaaactccccacggaagcccaattaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttcgaagattctgacttttgatacgatccacggcaatagtgccctgagccgcaaactcaacattcccgtcgacgaagaactgtatcgtatcattcgcctccgctactggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgacctcgcattgtattttcatacgacaaatcttgcaaataattaatttatggctaaaaaaagacgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtcttcgtggttgatgattgttcgactgatgacactggtgaacagattgccgcgttaatcaaaggcgacgaccggttccacgtgatcactcacgcccataaccggggcgtctccgcagctcgtaactccggtatggctgctgctaagggtaagtacctttgctttgtcgatggcgacgattgggtcgaaccagactttctggcaaccttcttagccgcctaccggtcagcacccgatacccagctcgttgtatgcggtcactacggttacttagccgttccgagtcctgccaaaacatacaaccaaaaagacttgattgccaacatcaactttggcacggttggcggtttttcgtggaataaagcattcattcgcagtattattaccacgcaccacctcaagttcaacgaagatattgattttcttgaagaccagttgtttgcctttcgttacgctaactacgtacagtcctccgaatacgtaccggaccggacttaccattaccgttggcgttttcgaagcaaccttgctcacattggaattccattcttcaccgctcgtcgtaagatgatgaagattctcaagcaggaaaacaagcaagttttgaacgaagattggaataatcagtagcaacgttacgttgccatcgcccctaaaggtcggtagctgaaatagctatcaccctttaggggattttttgatacctagcataatcggctacgatggccagaagatgcgcaattattcgaggctagtagccatccactcgcagtctggaatgcgcttccaccgccaattaaaccgaccgtggcgcgaaacaagctagctgctcaaactctttttgatatcagcgacaaaataaagtggcaattaacaattaaagacttgttgaatgacgagtaacgctttacaattggactatattaattaatttgatgggagggttagcgatggctacgattcacttatacttagtccgtcatggacaaaccaagctcaacgcggccggccgtttacaaggcatctatgattcggaactcacacataccggcgtgcgctccgcccaacggttagcccgcatgctagcagatgttcatttcgacgctgcttacgtcagtgacttgggccgagcacaacaaacgagtcgcattatcaccgcactccatcctgaaataaaaaagccgacgattgacgtcggcttacgcgaatttaacttcggtgggcttgaaggtaccagaaacatgtggatcgtcaagcaagtccaaaaacaattgggcattggaacgtttgttaagttgatgttgagtcgtgaacgcttcgccaccctactatgggtctttaactccctcgaccagactcgtggcgccgagactttggtcggtgtcacggatcgaatcagtagcgcgctacgacgaatctgtttgtatgaatctcaggatagtcagcatgacaagaatattcttatcgtttctcacgggctggttctcagtgcattcctataccaaatcagcccccgtgagcttcccacccgactcctgaaaaatacaagtgttagtcgcgtggactaccaaaatcggcaattcaagttgatcgacattaatatcacccctaagaagcgggcctagttgtctcgatgctaacaggttgcgtggtacaactcggaaattgcaagcgcgcctgaataccaaaaaaggctttgattttgcgttgtaattcttgaccagttgcatgcactgaagcttcactggcatctggatcgccaactacaattaaaatgcgactgcttttactatccaaattaggcctgattggggtggtagcatccgctgaaagactggccccttgtgccgttaaatgaagctgaacctgctcagtgccaagcgtattcatatcccacgcattgatctgcactggatggcgcgcgtgaatcacttgaagcaagtctgccaaagcattctgcggctgagcaacggcaagcccttgtgcagctaattgtttttcaattgctggattcaactcacggttatcaagattgctcatcgacaaaattgctagtggaatttccgtggtagtcgtcggtaaaatttcaattttcaacagttatcacttcctaaaaacacttcaatactaagtgtgccaaatttgacgtaaaagtcaattaccaccacttaagtcatagcgaaattttaataataccacaaaagcgattcccacacacgtgagaatcgcttttttaatggccttattgtcctcgtcgatacaccgatacgcttgtaagctgaccttacttagtcgttgataatgggtgggccgcgaagtatttttctaagaatagtgccaaaccatcattataattcatatcagttacatagttcgcaactttcttaacttgtggcaaggcgttgcccattgccaccgataagtcagcttctgccatcatcccaacgtcattcaaaccatccccaaagacaaacgtgtgggcggcatcgacatgttgctcacgttgaatttgtttgaccgccgtccccttatccgtattcagaggaatcatctcaatattattcgggttcgatgatgaaagtcgcaacaatttactattagtgagcttttcgcgggcagaatccagccgtgacatgtcttcacgactgagaatgacgccgttcgtaatctggtcctcaatcgtggctaattgcgtaaaactcttcacttcttcatagccaatcgagacttcatccgcatcaaagttagccgcattacgagcaacgaaccgtgggatttgttccgtatagtaggccatgtctggcgtgaacaacatcattggtaagttatcacgacgtgcaatcagataggcaagctcaaccgcagcacccccgagtttggttagctcacggccctgggcaccatcgaacaccgccccgttagacgtcaccaaacgaacgtcagcgtttactttgtctcgaacaatcttcgccagttcgtacatgcgccccgtagcgatgtaaaataacacgtcctgcttctgaaaccgttcaatcgtcgctcgagttcgctccgagacatattggtgatccgttaataatgttccgtcaatgtccataaagactaaatattttggcatagttgaactcctcctacgtatttacctatatgttgtgctagctaactgatcatctgtgacattcagcttgactgcttttgctgggtttgccaatcagtcggtaccatcctgccatcgtcagtaaatacgtaaattagcgtatccgcactgatgagtaagccggttggctggacttgaatgggcttaaattaaaaagatgacgcaccgccgccttttttagcaatcataattagcacaaggcttatttacactcccaattgtacgctattccctcctataatggaaatcgctttcaaaaccgaactagccaccgcattttcaccacgtaaggctaaacaatcttaagtttagaagctatttagggcattatttgccctcatcagctttatataccaaagaattcaatctaactacttgacattcaccagtctagccactaaattagagaacaattaataaatgatgataaaaagcattgaacagttcagtagttgccggccgttagccttagcgagtctgagatgatgtgagcagacctaatccggtatcacgaatatcgactgtgagttgtatgggtgaaatcaagtaacccgtactggttaacacccattaacgtgtggtacttctttcatgatgtgcttaaggtcagtaatgtaaattgctgatgaataccggtggtaacccgcgctcgcgtccggcagacgacttcgtctgtcggacgtttttattttcatttattaataaatcattttaaaggatggtcatacatatgcattttacagtactcggcgcaggcgccatgggattacgttacggtgtgttattacaagaagcaggcaatcaagttgattttgtggatacttggcaagcaaatgttgatcaaattcatcgtcaaggtggcgtctacgtgtcgcgcgatcaccagaatcgacacttagttcccgtcaaagtctcaactcccgaagattataacgacgatcccgacgtgtgggtcgtatttactaaacagatgcaacttgctgattttttgactcggacggcccacgcttttaatggtcaccagtacgtgctcacttgcatgaatgggatgggtcacgttgaaaaattattacactacttcaaacccgacaaattattagctgggaccgcactagttgctacggtcttaaacggccctggtgatgtcgacttcattggagctcgcggcgccggcaccatgaatctcgccaattatacggaacaccctgacgaaatgacccaccgaatcgtgacagaattagataaatgccaattccaccctaatttaacaacgaacttccgtggcaccttgctggctaaagtcgtcttcaactcagtggtcaacaccctctgtaccctctttgaaattacgatgggcgaattcgcggcctatccaggggctgatgagctgagtcgtcaattgatcgatgaagcctatgatgtctgtgagcgtggtggtgtcaccatgttgaatacccgcgcggaagagctcgcctctgtcaactacgtcagcaaagtggctaatcccctccactacccatcgatgtatcaagatatgtctcataatcggccaactgaagtcgactatatcaatggctacctcgtcaagctcggccaaaagtaccattaccaagcaaaaacgcacgcgtttctgacccatctggttcacttggccgaaaccacccgccaaaccagtgccacaactgaacacactactgaacaaaatacgcagaacgcgaccgaacaggctagtcaacaagcaagtgcgtaaccgattccccttttctcagcaaaatcatgtacaatggaggttaagttgattttactgaggaggcggtttgctgtgcaagtcagtcgggaattcaaaggtatctttcttgctagtatcagtgcgaccttctgggggatttccggagccgtcgcacaaacactttttgatacgaccgatattaattctatttggttaacaggaattcgcatgctgggtgccggaatcgcactattactggtcagtttactgacccatgttgatttgtggtcgatttggcgtcaaccccgtgatctcctacagatcgtggcctacacattattgggcctaatgccggttcagttcacctactttttagcagttgaagctagtaacgcggcgaccggaacaattctacaattcatgggacccgtgttcattgctctgtggatgctagtcgctcatcggcaattgccgacccgtgcagaaggccttgcgattatttgtgcactactgggctcattcttgctcgtgactcacggcaaccctcagaccctagtcatctccgtctgggcgttgatctggggactcttatcaggggtctcgtccgctacgaataccttgctgccaaccaagctactcactaagtacgacccaatgaccgtcaacacctggtcaatgttgttagggggtatcttgtttaacatcgttcagccagtctggtcgatccatattccactgactatgcttaatatcagcaagttgacctttgttgtgctgtttggaacattgttagctttcctattcttcttgcaaagtttgcaatatatccggccaaccattgtcagtctactagacgcttttgaacctttatccgcaaccatcattgcggtggttctactcggtgtcagcttcggttggctcgacattctgggcagtgtcctgattattagtaccgtctttattttggctattgggcagggtcccaatgatcgcacggcagagaatttcaagcaaccataaacgatgactcataattatgaaaccagtaaaagccggttgtgactaagtcctagtcacaaccggcttttacattgccgctaccgttacatatattcaattaataaccacgattcagatccacttggttacgtaccagcgtgccatctttgacaaactgtgcaaagttcgccgcaaagattggaaaaacggtcgcccgaaagtgggcaatttgacctgaaatatgtggcgtaatcagcacgtcatctcgttgccacaacgggtggtccgccggtaatggctctggttcagtaacgtccaacgctgccatactgagttgatgatgatccagggcggccattaacgccgtagtatcgaccgccggaccacgcccaatattaatcagcatcggttgctgtttggtctgctgaaataattcagtactaaacaaatgatgcgttgttggcgttaatggcaaagcgttgacaataaagttagccgttgctaacgcgtcagccgtcgcagtaaatgccactgtttcatgaaaatgatcagcggggtgaccggtcgtattgaccccaatcacgtgcatgcctaacgcactagccttagccgctaacgattgcccaatttggcccgtgccatatatcaacaactgttgcccggtcaaggtagatgtcgtcattggcaaggcccattgccgtgccccgcgctgattcagccaggccgcatggtacccccggactacgcttaacatcgcggctaagaccgattcactaatcgcatcggcgtgaataccactcgtgtttgcaaccaccaccccggccgcttgcaatgcctttaatggcaaataatcgacgccagctgaaatgacctgtacaaactttaactgattggttggccgcgctaggatcgtctttaataacggatgattaccatacatgacttcaatttggtcgtaatcggccgccgtgaccgccgccgcatccttgaacgtccagtccggataagtggtttgtaactgttgcagctgttcaggtttggttgcttgagccatcaataccattggcataacttattaccccatttctaatttcttgatcaatacttttatcataccactatcattcacttgaaccgtaatgatccacaaccggatattagctaagattggccagtaagttaggctgacccttttttagcccacagtttggtttaaatcacaatgtttgacgctactgctgacaaacggctcgcaaaataccaacaaaaaagcgatgttcgaaagtcgcactcccgagcatcgccaatcggtaactaacctaattgggtttaatcgttgaccaattatttaacaaccgcaaagccaccggtccagccgatttgttcactggctgctaatgtcatttgcataaaccccatcgcttcaagctcacgggcccgctttaacttacctgcatccttcacttctaacggactgtcagccaaggcgcgggtgaagcgttgcttggcgctatcgtcattaccagcaactaacacggttgttggtttcttaccattgacctgcccactctgaagcgtcgccgcaaaagtcgtattgaaagccttgagcacctgactatctggtagttgctgctgtaattcttgggcagccgaactatcagctggaacaaccaagtcatcccacgtgtcaaaattcaaggggttcgtgatatcaacgacgattttgcccttcaactgagtcgcgtactgtttagccagcgcagctaaagcgggataaggtaccgccatgatcacgatttcaccgagcgttgtggcttggtccttggaaccataataagtgacctcgtgcccagcgatttcaaaattatgaccaattgcttgccccatgttgcccttaccaaaaattgtgatttccatatcaaaacacgcctctttcgctttataattaattttatatttacatcctaacattgatgtcccatttacatcacttttatgtctgacagttaccgcaaaccggtcgtcaatcgccctagctagtagtcgctccttgaatgacgacaattagtggaactaatggctaatcagctcggatattcacctgcctgcacgcttcccaggttattgacacgagtcgatcagtcactaacgaccaaaaaccgaccaacttaattatgaattaattaagctggccggtttttaaattttcagtcgatcatcaagtttactggtctgttacccccaaaaattaattattgcccgttgccgtactataaccatctgtagaagaagcagtgccaccggtcgttgttgaagacgtatctccataattcgtcgttgagctactatcggtgtttgcactataactgtagctaggcgtacttgagcttgacgttgccgagctcgtgtccgtatcgttgctataactatgcgttgaagccgaactactgttgtcactactttcactataagtcgaatatgatgaactcgacgatgattctggttcactatagctatacgtgctcgaacttgaggttgaagacgatgcgttattcgctttcgccaacttcttgcgatccgtaatcaacttctggtaatcatcggccgctaactgcgactttttgcgataagctttcaggtttgcaagtactttatcgactgtcgttgacggggtcgaagccttgagtttatttttcttgttatataatttttgaaaatcagcatcatagctgaccactttcttaaccgtttttcccgttgtcgtaaacaacttgtcatacttcttagcaaagtacggcttactactcgttaagccagcagtcgtcaaccgctgctgacccttagtaatggtgtccatggtcacgtcggtcttaagtaaccccttagcgttgcgtaaatcttggtaactagtccggaccgtcaacatcttagcagccgtatcatgctgtttctgcaaacgggtcttttcacttgaatccttcatattatcaatattattttgcaacttggtcaaagtcgagcttgaggcactcgcccgcaagtcccgttgggctgatgatgtataaacttggtccacgatcttttccgcattggttcgtgccgcagcttgagtggcttgcccatggttccacatgaagaaagctccaccagcagcaacaaccagaatcgcaacaccagccaacatcaacttccagttatagcgccgagctggcttcttaagatgtggattcttttcatccgtttctaactcagaaaagtcacggtcgtcatccggctgatcatcatgtggtagccgctgttcttcgtgccgagcgacccgtgacatggttggcttattgggctgcttgccaccgttgggctgctgatcaccatacaactcttcacgtgataatggtaactcaggctgcgtgtcatcatccgcttgttccgtccccttgaccgcaatccgcggttgctgtttacgagcaaccggtggaatatgatcagctgggatgcgcctttcgaccttcggctgtttagcagcagtcgcttgcggatccttagcggttgtggccgtggcctgagataccgcagatgtcgctgacttgggggctgtggacttcggggccgtggattgtgctaccgcagatgcggcggccgcggcactcgatgtcgaagcactagactgttgactgtgcgtcttggcctgactggcagcttcctgactagcacgccgggccatccgcgtcattggaacttccgacgttgccgccgactgatgaaccttggtacttgctgttgttttagccacacgcttctgatcagacactgcggtgctggttgcttgtgacgcttccttagcggcccgcgctggtgccgattgagccgcactagctgtcgtcgaagctgcgtgcttggaacgctggtcacttactgcctgtgatgagaccgcgctggccgtctttggcgccgcctgacttgctgttgaggccggtttagttgcggcggactttttagttatttgcgcggattccgcctttgacgacgactgagaaccagccgagcctttttgcttaaccgcactagtcgccccatgcttgacgggtgccgccgattgttttacagcctggcgattgtctccggaatggcgcgcttttttagccaccttttctggttcaattactgcgtcaacaggttgcttttcggcactgttattcgccgtcgagcggggaatattgaccgttgattttgcttcggcttcgtccgcctttgatgcggccgagtctttcagatcataggccaaagggatctgttcattatcttgttcagtactatcatcgtcgggaattggctcagtaatcgaattccagagccgtctacccaatccttcttttttattttttctagacaaaaccaacgctcctcgccaatttataatttacattagattcctggttaagcgccgaccaaaaatttttatcaatttcggtaaaataaccattaatagttaaattatagcatggaattggctactgagaaaccactggtcaagcggatttgtgaataactgcccaataccttaaattaaggttaaaactctgctataatcggcttatcaagatatttgaaagcgaggagttcatatggctactgcgaaagttatttttgctaccattaccggtaacaacgaagacgttgccgatattattactgaaaaatttgaaaagcttggggtcgatgttgccaaagaagaaatctcgcaaaccgacgcaactgaattcaacgatgttgatatttgtgttgtcgtcccttacacctacgatgagggcgccctccctgaagagggactcgacttctacgaggacttacaggatttggatttaaccggtaagatttacggctgtgccggctctggcgatactttctatgatgatgattattgccgcgccgtcaccgatttcagtaacgcgttgaagaaggctggggctactcagggtgccaaggacgtgttcgttaaccttgcaccagaagctgatgatgtaaaagccctggatgcatttactgaacaactcgttgctaaagttcagtaacctgactagtttgattgagtgaataacaaagaaacgcttcaagaattcatgactaattcttgaagcgtttcttttattaactgctatcgacacatcatcctgacgctgataccgaaaatcacaatcaccgtaatcacttttattcagtccttacgatttcgagcacgttgtttaatggcgtttcacacgccgaaatccgagccaactaccgaacatggtcaaccccaatagcactgttcccatcacatttgcacgacttggcgcttcaccagtttgcggtaaagccgatgtgccgagtttggccgttacaggctgaacagctaccgaagctgattcagtcggccgtgattcttgatgatgaccgccaacggtagtttgcgcgtgttgcagactagctgtgttggtcatctggctccgatgcggccatgaagtgactactgatttagccccattagccgtcgtttgcatgccagaattacgatccgcaccctttccatgattcgtgccaaccgcgggtgttgcgtcatcaataactgcatttgcatcaacgtcagccgcatcaccctccatctggtcagcatcattcgtaggtatttctgcttgatcatcaccatcgatacttccagtcgagccgccgttcacatcgtcattggtattggtagcgcctggctgttcagtattcgtatcgccatcgctcgccgcaacgaccgtgactgttgccacgcgagtgaaaatttgaccactcgcatccgtatactgataagtcacctggtaaacaccggcttgattagtatcgaccgtgccagttacgactaggtcagcaagcgacaattcaccgccattaacatccgtagccaagactaaattatcgcttggttgccacgactcaccgacagtaatagttgaatcatgaatctgtaaatcgctttgggattccgcctgttcatcggcctcctcgataaccagcgttaccgtcatcgttgccgtcaccaactgaccagtcttgtcagtaaattgatacgtcaacagatagtccccggctgtagtccaatctggcgttccaacgacctcaatggccgaccagtctaatgtttgaccatcactatcagtggcattctgaaaattgctttggggctgccaagtactggttccctgcccatccgtatgcaccgttgcgtggttttgatataagttcaaactggcttggttttccttaacagttacagtaatcgtctgcgtctgactaccatacgtgtaagtaatctggtaatcacccgggaccatggtgttcacttcacccgtcaccgtcacatcgttaaagtcgatggcgtgaccgtcctgatccatcgccccgtcaaaaccgtcctgcgcatgccaagtgccaccagcgtgtagttccgtatcatggacagttaaacttgtctggtcagccttcacgatcaccaaagcagtgaccgtcttacccgcatacttgaaagtgacccggtaagtccccggctgactagtatttacccggtcacccgatagtttcacagcctggggattagcttcatagagggcctgaacatcgactttttgaccaaattggtcggttaaactctcgatactgtccgtccagttccaatcatcgccaacttccagggtaatgtcgttggcatcgataactgcttggtttgcttcccagatgtaggttccaatcggcatattttttcctgaatacagattcatcagttcagcactagttaaccgttgctggggattggctacatttatccagtaaccggtatattggtcattagcttcaatgtccattagcccaaccgactcgattttggctggcgtcaaatcagtatccggaccaagtgtaattttttgtagacgctcacatcccgcaaacatgtcgagattttgttcaacgcgatgcaaattaaaaccagatagatccacctcagttaaattggaacatcctgaaaatagcaaatgaatccaagtaacctgatctgttttgaactgagacccgaatttaacactggttaagttgtgcatgtccataaaccaagcagccatattgtcaaggctatcagtcttccatttggataagtctagctccgacaaccccgttttgataaacaaaccgcctgcttcttttaggctttcaaagttcaaattctcgataccaataatacgagttaacttttcattgggaccaaacatgtagtccgcttcacttactcgacgagtgtcccaccctgaaatattgattgtcgttagttggctagtccctggagaattgaaaaacaggtaagacatatcagtcacatttcccacctgccagctgctcaaatctagctccttaacatgcgtattttctgaaaagaaatatcttaaatccgtcgcagaactaacatcaattttttcaagcccttcatagtgttcaacattcgtcaaattttcaaagaagcccccactatcacctataatgcgaattggctttgaaatcacaactttaactatttgtaacacccacgattttgattgccacggactatccccatagcaatcgtaaatttcgccaccgtccaacactaatacaccagaatccgcgtcaaaatgccatctaatgccatcggcgttgtacccagcaccccagatgccggccatcgagtcgtcgtcttccatatcatcgttgcgataaccatccgtgagatgtgggcgttctggatttcgaatcacgccagccaaatcaccgcttccccgctcattgatggtttccgttttatgctgcgacgacaagacttttgcagtactatccgtgtcaatatcttgcgactgctcgtcggcattaactggctgttcagaatcatcagttgtcgattggttcggatgcgtatcaagtgttgcagtatgttcgtctgacggaacgggggtctcactgtcaacttgatccgtgaccggtacactgacctgatcagaattcgcatgctcatcatcagattgattgacaatctcatcagtatactgctcttcagcggcctgcactttaattggttgagcttcagttaccagttcactcattgcggattcatccatggcgtcggttactggggattgctgctcagcgttaccttcagacaaagttgccactgccggttcagtcaatgcttctacgtgtgttgattcatctgctcgtcccgtcaccacattcatgttcaacgtaacgagcgtgattccagcgaacaaccacatcttaccactcttgtacatcttgtaccgtttcttcacttgttccattaatttctcactcctttattaattaaccttgccgacgtttaatgccgacgatgctggctaaaccagtcaccattaacatcatgagtcccagcaacccgaagcgattaactcgttcattagtttgcggtaactcaccagctactgacgctgaatgactgactggggccataaccacttccggttcagctgtatcaaccgtagcataccgtttaccatcaattctgccctcattgcgttcagtcgtgtccagtttcaatttatcacgaaacaccgtggtcacttgcttctctaaaccaccgttaaattctggtcgcactatcgtgtttgcttgttctctttgactgctggaaccagcgtttgcgcccgttaaaccactgttaggatcactagtatcagggtgttcagtagttcccggttgttctgattgttcaggaacttccggcagttctggttgatcaggtgtccctggcgctgacggttcccctggtatttcaggggtttcaggggtttcaggctgttcgggtgttcctggttcttccggtaactccggttcagctggttctcccggtaacggcgtttcaccattgccagcaccttcgactaccgtaatggtggctgtttgagtccactgcaggccattggcgttcgtgtattgatacgtgatttcataagtaccgggttgcgtcgtgtcaacgtcaccaatcacaactaagtccgctagtgttaatggccgtcccgtcgcatcactggctcttacgaagttgtctgccgcctgccagtggtcgccaactgtcaccgttgtatcttgaacaaccagttctgtcaggtcttcaacgtcagcctcttgttcagtcaccgtgacggtcgttgtcgccgtgactaactgtccggtcaagtcagtgaactgataaacgacctcatatgtccccggccgtgttaagtctggttctccaagcaccgtcacgttctgccattccactgaacggccatctgcatccgttgcactcgcaaaattatcccgtgggcgccagaccgcacttcccgttgcgagatcaatttcaaccgcaacctcttgcgcatgcaagtttagttgactttgattagccacaaccgtgacaaccacggttgtttgccgacccgcataagttagtatcacgtgatacgaccctggctggctggtgtcaacaggctcaccgctaactgtcaccgcttgggggtctgtactgaacaagactcctggatcaactaactggccattttgatcaactagttgcgcaatattttgtgtccagtcccatttttgattcaagaagagcgtgctgtctttaccggtaatcgcggccgcagagacggtttcccagacaaacgtcgccgtgttagcgtggtttcccgaatattgcgccaggagttcagcactcgtgaacgtttgcgagctatcagctacgttgacccatttgccggtatatttgctattcttaggcacttccggtaaatcaactaagggttgcgtgccgtgttgactaaaatcaagtcccggaccaagtgtcaacgtttgcaaacttgtcaaaccagctagcatttgccagttttgttcaacattctgcatattgaaatgggacaagtcgagcacctttagtttggcatcatcattaaacaaactattgatttgagtgactttagcgacggtaaactgcgtaccgaattcgatacgctccaaatcggacatctgcgcaaaggcaccatcgatttcaaccaggctggctgaatcaaagctcgtcagattcaagtgacggacgcctgtgcgcgcaaacatgttggccatcgtcgtcacactgcgcgtatcccagtcagtcaaaccgtcaatagttcgaagttggccgttgaactggaacatattttgcatgttggcgacattatgagtatcccagccactgagattgaggtatttaagttcagtacccatgaagttccccataaacatgttcaccattgtggtcacattgccgacttgccaagcactcaagtccagtcgctctagcgaggtattttctttgaacagagactgcatgttggtcacagcactggtatcaatcttttctaacccttcgtaacgcgtcacgctgtcaagattcgcaaacagactattcatgttagtaccggcaacaattttgtcagcaatcacgatacacttgatcatcggcgcccaagacttgcgacgccaaggattatccccataactgttatttaacgtgcccccgttcagcgttagcgtgcctgtactggcatcaaagtgccaatcaacgccaaagttaccagacatttcatcctcatccgctctagtcacagcacgagtatcaacgtgctgtgactccaccttaaggtcatctaccagctgatgctgctcaacttgttgcaagtcagcggcggatttacgttctgacgcgtcagcagtatcgagtaataactgttcactcgcttcaggctgttgttcactaacggtcgattctgcggcattactgaacagatcgtcagtccgtgatgcttcataactgttcgtcgcgggcgctaccgtatttagtccgttcactgctgccatcgaatcagcggctacctcactattgggcgcgccagatgtcccgttcaacgcagccgttgatgcagcggattgcggctcgtcattagtagctggctgtgcatcgattaccgtctgattagtaatcgaagcgttctcatcattagccacgacaacgttatccgttttagaaaccgaacttgccagtgtttgattgctgctaccttgattttgaattaacacaccgttagtcgctacgacactcgtttcgctggtcgatgcagatgttggttcatccgcatgtgcggttaacagttgagtattcaacaataatagtgaagcgctcgcaaacaaccacatcttgccacttttatacattttataacatttcacttctgattcacggtaattgataataattccccatttcttcaaaaacaacctaactgacctaacgattaatctcattaaataaagtgttcttactatatttgattatcgtgtttaactagtacatcatttacggtttttaaatataccatggtaccctcataatgctcaactgattatcacaattctaattaacctgttatcattatgattaatccgcttgtttatcgcaaaaatataattatcaactccctatttctgcaatcgttttcatcgtggtgattcattaattctggtcgttttagtattcgaccaccactattcgttcaccatactgacagttgcatcatgcaccggtcagctgtcaccatggcgactgaccagtgtcttccagtaatccccggccatcaaaaaagccttgagcaatattactgctcaagacctggtttacccattctaatagcgtatttccctaatttgaatcgaaagactccccccgcgtaatcatgagctagtagatacgataattgtcactcggccccgagtcatttggatcgtcgtttcacaacgatttgtcgaatcgcattataaactagctcaacgatgacaaacagcaccgtgatacccacaatatcaattaaatacgaactaagtcgatagcccaccttgccgatccacaaatcatacggcccttgaatcagtaagaaatagatgactaacgtttcaaaaatcgtccgggtatgccgccaaaacgatcgccattgcattgatttcacgccccttcaagtggtgccaacatttgtaacgcctgtttgacctgactcactgctaattgactttgatcaccgacccggccgacgtgtccaaaggcaactgccgaccccgtcaactgactacagacactgttataacgaccaaacttgcccatcgccgttgccacgattggcacaactaattgctgccgtgcttgctcagttgccgccattaatgccaacaccgtctgtgcatcatgtccagccactgtcacccgcacgacatcagcaccagttgctgctaattcgtgataagtcgccaataaatcgtcagttgttgctgtcgtgacggtctggctcgcaattaaccgaatttcgttggcacgcatctgtttggtcaacgtcataaaatctggctgattgaccatggctaagtcaatatccacgccagccacgcttcgattattcactaatgtttgataagtttgataatattcggtcacttcagctggatcgtttgccagcccaaacatggcaattaatggaatcgtccccaaaacttgttgcaattgggccgctgtattgactaactccgcacggttatccaattcctgataaggatctaaccgccaaacaacaatttgtgccaccgaagttaaaatctgccccgctttacgcaagaggtcctcccgtgtggcccccgctaaaacaacaccaatcttaggcatccctgtcgctaacgttaactccccaactgtaacttctttcaagaccattcctgctttcattttcattcgaacaatgcgcgtccgttgccgttaaattttatctcctcttaacaatagcaaattttcgctgttttgacactcaaaattcattttttgacttaaaatttaaagcgcttttaatattaacttgttaatactggcaccgctttcaatttggccttacaattaagcatactttagctcacaaaggagttcaacatggaaaacaaaaaacaacttcgatggtccaacattgctttaattgcattcgtggcggtctggggcctaggtaacgttgtcaataactttgcgttacaagggctttcagtcgtcacttcttggattttaatcatgattatttattttattccctacaccttgattgtgggtcaactgggttcgacctttaaggatgctgaggggggcgtctcatcttggattcgagcaacgagtaccaagcgcctagcttactatgctgcctggacttattggatcgtgcacattccgtacttagcacaaaaaccccaagggattctaattgcattcagctggctgttccgcggtaatgggaacttcgtcaacacgacacctgcgttagtcgttcaagccatttgtttagtgctattcttattcttcctctggattgcttcattgggactaacgacactgaaacgcatcgggagtgttgctggtacggggatgttcatcatgtcgattttattcatcatcttggccgtatcagcaccgtttatgaccaaggcgactgttcagacaccgaacatgttttcactcaagtcctacttacctaagtttgactttacctactttacgaccgtttcaatgttagtcttcgcggtcgggggatctgaaaagatttcgccgtacgttaataaaaccaagaatccgggacgtgagtttccgttaggcatgttagtgctcgcaggtatggtcgcaatctgtgccctgctgggttcatttgccatggggattctgtttaactccaagcacattcccgctgatttgatggccaacggtgcttactacgcgtttcaacgactaggtgccttctaccacgtgggcaatctgttcttgatcctctacgcaattgccaatgtgcttgcccaaatctccgccttagcgttctcaatcgatgcgccattgaagattttgcttggtgatgccgaccctgaatttattcccaaaaaattaagtaaaatgaacaagaaggatgtgcccgtcaacggttacatcttaactggggttttggtcagcattctcattatcattcctgcattagggattggaaacatgaatgaactctttaattggttattgaacttaaattcggtcgtaatgccgatgcgctacctgtgggtctttctagcttacatgctactcaacaagcacttaaaggaattcaagagtgattacaagttcctgaaaaacccagtcgctggccgtttggtcggtgcttggtgcttcctatttacagcatttgcttgcatcctcggaatggttccaaagacttcctacgctagcaatcctagcagttggctcttccaactgactttaaatattctaacgccaattatctttgttgccttagggatgattttgccgatgattgctcgtcgtcatcgcactaaaaccgcttagtgcgtcaccgatctttgcgcccgcatcgtcgctctacgcctgcggactcactgacttttttgtaacgttgatcgataatctattcgccaccgctgacagcgcaaaaaactgtcagcggtggttttgatattaccaaccgttgctagtaggcatgcgtgttcacatagaatttcagtcactaatttgcggctcacaatcttacactttttacacgtttagcggtatgatgcttagtgaatatagtcaatccaaatttaccaagctgtcgctcttcaaggaggttcttatctatggctaccgtcgacgctctcgacatgtttttgaccgattatgccaatatctctcgttacctgaatactcgcttaaattcactactgaccacgcaacatcttacctttgacgcttttttaatcatgcatgaaataggtcaaagcccccagccactattattaatggagatcgcacatcagcaccatgtctcacgcagcgcaatctcacgccaaatcggagtcctcctcaaacatcgatacattgagcaacaggctaatgccactgatcgccgccaaaaaggactttccttaacggctaccggccgtcacctagatcagcaactaatggccaccatgcacaaaacggttcaccagtggacgactcaattgggcccgcaacgggtgaagaccctgctaggcatcttcaccgactttaacgagcaaattatcaataatgaggttcccgccagcgattaataaccagccatcctcagcttcatcattcggcattagtcgtaacgtgccccattttagtaagctgatttttattcgtcgccatttcaagttacggcttttaaaggccttaatcaaaaaacggcgccatggatgctagtgattctagcgtccatggcgtcgttaattttcagttacaatcaaagcagcttacactacggtacgttcgtccgcgacttggccggctctgccgctagtcatctgcatgcacgtcaaaggcatgcaacaactgttctgaaacccctggcgcatctgggtcgtggtgacctttaccggtatctaaagctcgtaattgggccatctcagtcgaagttaattcaaagtcgaagatatcccgattactcttgatccgtgcactgtgcactgatttaggaaagacgatcacgccttcttgatgttcaaatctaagaatgatttgaccagcatccttatgatacttaatagccaattgttgaatgattggttctttgaataatgcttgattgccctgacccaagggcgcccaagcttctaatttaacatcttgtgccgcgagtaattggcgcaagggttgttgctgaaagtacgggttaaattcaacctgattgactgcagggatcgtttcaaattgtggcacaaatttttgccacaacgttggtgtcatattggaaacaccgatcgactttaatttcccggccttttgggctgcttccattgcttgccatgcacccggaacatcgccataaggttgatgaattaagtacaagtcaatatagtctagtcgcaacttagttaacgaacgatcgatggcgcaactggctgcatcaaagccgtagtcttggagccaaagtttactcgtcacccagatttggtcccgtggaatcccactatccttaatagcttgaccaacttcgtcttcgttaaaataggccacggctgtgtcaatgtgtcgataaccaatcgccaatgcttctttgactgcttgataagtggaaccgtcgtctggaatctggaaagtgcccaacccaattgctggaatcgcgcggccatcatttagcgtaatagttggtgtttttgtcattaataatcactccttaacttattcatgtaattgtcgtaaactagcgccaaaaatctgttcaattgtcacaggatcacgatgatcaaagaactgactgacgccctgatcaagttcggccattgctgacatttctgcagctgttaattcaaaatcaaaaacagcgatattctcagccatacgttcaggatgcactgattttggaatcaccgtaatcccgcgttgcaacagccaacgtaagatgacttgtccggtcgtcttaccatgggcctgtgcgatagtttgaatacttggattactgaaaatcgcatgcttaccttcttcaaacggtgcccaagcttcaacccgtacgtgttcaccttgattaaagcggacctcgtctgcttgctggtaccatggattgacctcgatttgattgacagctggttgcacggacatggtcagttccaagttctttagctgatccgcataaaaattggaaacaccaattgcgcgaatcttaccagcatggtaagcctcttctaaagcacgccaagcacccatcacatcgccataaggttggtgcaaaagatacaagtccaagtagtctacgcctaaacgttgtaatgacgcatcaataccttgctttgcacgttcataggtgaattctgagacccacagcttggaagtgacaaagagttcatcacgtctaagaccactcttttgaattgcccgccccactgcggtttcattttggtatgccgttgccgtatcaattaaacggtaaccagcctttaaggccgcggtcaccgctgcttcacattcattcaggtcagggacttggaacacgccgaatcccaattggggcataaccacaccattgtttaatttcgttgttggaaccatcacgcatcaacctttcactatttgattacaataacaagcatacccgcaaacctaatacttgaaaattactacttattcatactagtatacatatagcgcatactagtaacggaggttcctgatgattgaaaattatttattagaagagctgatcacattcgcccacgagcacacgctggctaagaccgcggccgcattaaacgtgacgcaaccaactatcactcgcggcatgcagaaattggaaacgatgctcgctgttcgcttatttgatcgtcaacccaatcgaattacactgacgcccactggccagttagccgctcaggaagctgaacaattattgacacaacaacggacttttgtaaccaaaatacaaaactacgagcaaagcttagtcacacgtaccgtcgaaaccaccctacctggtccacttgccttactcacccatctcaaaacggtattacctaatacattgcgagttaggcaaccattgattgccgacgaccaaatcactgagcatctcattaaccgccaggcaagtttcattttctctaatcaggaaattctgacggccggcattgaatctcgcttcatcggtactgaaaatctcgtggtccatttacagcgattcatgtaccgtgcgaaccaacctagtatcacattcgccgaacttaagggaattagcttcgtagttctaagcgcaatcggtatttggaaagatattattcagcaggccatcccagatgctaaattcttataccaaccccaacgcacggcctttacagaaatcactaaatactccgatttcccgtacttcagtactaactttaccgcattggcgcctcaccagctagatagccaagccgatgatgacaatcgagtcgctatcccgattagcgatactcgtgctcacatgccaatctatgtcaattatcttgttagcaatcgacaatcattaatgcccctattcaagcaatttgaagccgcgtggccagccaatctcaagcatacttccacgccctagcagctaccatagttaagccgttcggtctaaaactgcaaaatgaagtgttacgctcaatcacagggggtatatactggttgaagctcgccctcccagttcttgatagcaaaagaggtccacacgctcgcttagctaatctaatgcgagcgtgtggacctcttttcgtattaagtttggttcgttcaagtcttaatcttaaacatggaccctaatgtgatgattagttgcagaaaaaacagttaaacaagcattccacgccaatcatcttctaacagcaagccgtttagcagatttgaactgccgacctcttccttaccatggaagtgctctacctgctgagctaaaacggcgttaattgaccctatccagtataccaaaagcatgtctaaattcaaactgtactggttgacattcaacgtaaaaaaaaagaaatcgaattaacgattccttannnnnnnnnnagttttcaaagatctaattccatgcgttaatcgcttaacacaacttaatcatcataacatcttaatcaatatcttgtcaacaactttttttaagaagtaacttgattaatttgtcgtggttgccgttgcgacaacagaaattatcttaccaattactgaagaagttgtcaacaactaatttcaataattatttggtggtgagatgcatctgccgtagcagcaacgtttactaatataccagccagttatgaaactgtcaacaattaatccaatgttttttcacttttatgaaaagaacggcacaaaactgtcgtcaattacacaattactacattatatgtcatcgattaacatcattgtgagatggcactatgttttccaattaaggattccctttagacagcaaaaaagcgcccgtaaaagcacgacgaacgcttatcttaagccagcacatctaattttaaaaattcaaatgacgtttaacgattggtcgaattcccgcaacaattgggaatgccaagataccaccaaccacagcttgaactaaattagtcggtacaccaaccaatccagttgccatcgtatacaacagcgaatctgacaaaaagtatccgaccaccatcaccactaccgcagtaattatcgctgcaatctgtcgaccatgtgatttgctagcaccaagatatcctgctattccgccctctaaaccatgaacgagtagtgagaaaaacatatactgtggataccctagcaataaatctagtaatagtccgctagcaccgccaacaatgaccccaccacgccagccaaaaatcagtgctgcaataaagattcccgcatcacataagttaatataaccgtgtgtcatcgggattgggatatggaaaaagatagaaataacaacattaagtgcgatcaacatccccaggattgcaatcgtccgtgtattaaatttaacccccaccaaaactttcatctcctcaattgattttcatctggcaatgatcacacattattaatgtgacctaaataaattttacaccagttcttacttgtaataataataaaaagactgggccacaacgggtccagtccacctgctaaattaacttacttaacatgtgccaagaagtaacgtttcttaccacgacgtacaatgacaaatttaccattaaaggttgcggacggatcaatctcggcctcgacatccgtcaccttttcaccattgattcgaatcgcaccgtttttaatatcttcacgtgcttgacgccgagaaggttcgaatttcgtagcatcaaccagccacaagacaatgttttgcttttcagctgagacgtctgctgatggcacacccttgaaaccttgttcaatttcgtccgccgttaaactttgaacatcaccagtaaacaacgccttagtaatattttcagcttcaactaccgcctgcttgccatgaacaaattccgtgacttcttcagctaagcgccgttgtgcttcccgtttttcaggtgcagtcttcaccgtttcggccaatcgatcgatttcttcatgacttaagaacgtgaagtacttgaggtatttgacgacgtctcgatcatcctggttgatccagaattgatagaattcatacggtgatgtccgttcagggtttaaccatacggccccaccagcagtcttaccaaacttagtcccatccgccttcaacaataatggaattgttaatccgtaagccttagcgtcattgccttctaagcggtggatcaaatcggtccccgcggtgatattgccccactgatcagccccaccaatctggagttgcacgtgttcagcacggtacaagtgtaagaagtcaactgattgtaagatttggtatgtgaattcagtgtatgaaatgcccacttccaaccggcttgcaacaacttccttgttcagcatcgtgttcacactgaacaacttaccataatcgcgtaagaaatctagtaatgaaatttttgataaccaatcgtagttattcacaatcgaaaagttttcgtcatgaccaaacaacttgtacatctgagcacttaagccatcctgattatgcttcacttgatccatggtctgtaacttacgttctgagttcttaccagatggatcaccgatagcacccgtcccaccaccaactacaacgtagggatgatgaccagccaattggaatcgtttgagaatcatgaaaggaatcaaatgcccaatatgcatactatccccggttggatcaatcccacagtatagtgagactgattggttttcggtaagttcctttaacccggcctcatccgtttgttggttaatggcaccacgccattttaaatcatcgataatgttcatgttagtcctcctcgttattgtcgctggacaaaaaaactcgcccctgtcatcaaaacagggacgagttttccgcgttaccacccaagttatcaccaaatgtgatcgctcattgattagtaacggatatcatccggccaatggcagttcacgttatgtaattcatctttgaccacagctcggttcgcaccacccaccgagtcgctagactgttgggtcaacgactactaattaacgatcactactttttaattattacctaacatcataagcactccactgccaaaagtcaatcctattttcggtcaaaacatcgcattaaacccactaatctaaccatagtgtctggcttgtgaatgcggttgacgtcgacacagtgatataaccagactactggcactcatttattgagctcccaggtaaaaacttaatttttagcatccgccgcaattttgataacggtattggcttgctggccttgaaccttagcaacctgtttgccattttgccattgaactgagtttgcctgtccgttttgtggggtatcgtacacggtaacggcaccactcgtgacatttttactcgtcaaatcttgcttttgaatctgattattgacctgattagcaaacttggttggattaccagcaacgtcctgtgtattggcaatcgttgtcactgaccaactacccgtgttccaatgaacatacactttgcccatcgtcccttgaaccgttgccgctgtacctgaattaagtgtcgtacgctgaccctgcgtattcgctaagtaatcgacttggctgctggcatcacttttcgtattgtagttcgtctgttgatacgtcgcagtcgtcgaactagtcccagctttggcgtacttcacccggtagtttcccttggtcccacttgcactgatggccttgactgtttgattggttgccttgacggtcgtaggcgctgccgtctgactaaccaaactaacactgtctgaagccgcgtgtaatacattcgttactgaaggtacggcaacaattccgaccaccaacatcccagttgcagtggcgattcctaattgaattttgcgcttaaagttcatgaaaaatatcctcctaatttctacaacaaatgaccgattttacttaaccataattaccttttctaccatgataatgagaactgagcgacagccatgcaatcagctaagtcctcgcttgtcccgagaagtgttatgtacgggacgtatttgtgttcgttgccaacgtggtgcacgacgaatcgtcgaccctcgccgctgcaccgttactcgtagtgcgcggcggcgggattgcctgtttttcgttactcgctgcctcagtgacggttgacgtcgcgtaagtcgctgccgcgttcgcccttttgaacgagtcaccggttttgttcgaatactcttaccgggccgccgaagtttagttgctttggacgtattcagtttaaactgtgttcctgtacgtcgcgtcgctttaagttttatcactttgggctgagtcgctcggcgtcgaatggcgcgatgctgagttattttgccatgatggctgttaacactgatcgtttgcaatgaccgccgtttgacgcgcgccacggtctgcgaacgcgacttattgcttaccactttctgctgcaccggccgagtcttcacagctggctgaactgctggcctcttaatggcgacaactgcttggcccacccgtccatgctgttgattgtgggccggcatagtcaaatggcgatcgtgcacaactttcagtcttggttgagctttaatcgcaacaccgggtgcgccacgggtcgtccccaaccaccacgaaacgggatgaacactagtaatgacccaactattatcaaccggtgccgctagcccagctaaatgatagcgattggtatactgccataacgccgccgaaatgattggtgggttgggcgttagcgcaccaatccactgggcatcaaaccgttgccgcgcttggttggcatacgtcagtgcgaacgaagcatacgaatagaagatcagttttttgttagtcaatgcgcgcatttcacgataccaagccgcaactgccgcattagttgatcctaaacgtaccgtattaacttcaaaatccaaagcataaaaacgcgcagctttattggagcgcgcataaaacgcttgggcttcacggcgcgcgctagcggcatccgtaaattgcgaaaaatcatactcaccaaatggaatcccataacgaacatataatgccgtattattcgctgcgtcccggtcaacataatttaaaccatactgacgacgattgatcacaaatagcacttgcgacttcatcgcctgcacctgacttgggctgagctgtccttgccactcggaaatatcgaccaccgcgtgtccctgtgcttgaaccgtaatttgcatgccaagtgtggcgaccaccgccgttccaactaaccaactgagccttttaatccccatcatgcggtccctctccccatactgtgctccgcaattaaaaaaattatcatcataagttgttggtgattcccacaatcaccaacaactaaactgtcaaggacagtttatgacatacccataactttaacattcttatactaccaataataggccatttttaatgggctggggcgtcaattcgatttcaattcagttacagcttgttaacaaagcgtcgcccctttatggttaatattatgaacaactctggaaaggctgatatttgaattacagtttggttacaatcatgatattgttagcagtttctcacccgctttccggtgcccgaactacccataccacgggatattacaaccgtttcattcgaaaataccgccacaaaaaaagcaactaatcctcatcaagattttggctcatcttgaccaagattagttgcttaaactaattggttcacaatagcatgttgttaactaactaatgtggtaacgtcagaacaatggcttgcttgcccatctgattataagcagcctcaaaattcttccagctgactgcctgctgtttttctccgtacggattgttaatataaatcaactttttagtccggttaaagccaacaatgaccacgctgtgcatatcataagtcactttaacggagccctgtggtgtctgccaagtttgcatcgtgctgaccggtgcaaacgaagccgtcgtaattgtccaaacgggccgtccttgttctaactgttcaatcacagtatcaaagtttgcccccgttaagtccttcacctgactagtctcagttttcgccaatttatagattggcttatgatagacacctaacccaggatcgttaccagtaatatccccaacaaacccatactctggattcccatgttcgccgtcactataagtgagtggcacactcgtaatctttgccgctaattcatttttagtgacattgatatgcgcgtaattcatcaacatcgttaacgatgtgacttcacaaccattgtataaacgtggtgttgtcatttgattcactagcgggacgtccaacttgacctgattgaccgacttgggcttcgtttgggaactagacttagctgcatccgtttgtttagttgtaaacgatgcatcaatccagtcagaaacttgtgtgcttgtaaatccaatgacccccaaaagcaccatggcaattatgatcagcgtccaggaccggcgccgtttccgtaaatgtcttggcatttgttaccatccgtttctcttttaatttgattgactactttactaacatactatgtagtatcataccatggacgaatcaataatacacctttacaatcttaaaaaaaaggcttgtataatcagccgtaagtcaatgctgacaaggattaaggttagcctggttaatcattaagtaacacactgctttaatcagtttattgatatattagtaaccttattatcaatttgttgaattagccctgaccgttacttagattataattgagattatctggccgaggctggcttttcccaaaatggccttgaatattcgttatttgccgatgaagtcaactttcctaattctgggcaccttcgttattttatgaagcactgagtccttgttttcaaaacagcattaaattggccccggcaaatccgttgcgtccttagattatctgtcatccgtttcaagcctagtggcatccaaagttttaacttctgatcagctttagaaaattttatgttgattaaagcgctttctttattacgatagtagtaaaagcagttaaattttatggttaattgtgaaaggacctgactggcatggctaattctgaagaccaaatggataaacacttacaatccgcaatattcggggcccccgtactacatccggatgaacaacaccgtaaccttggcacgtttcacgaacgaatcgatgtgggcattactttcacccaagcactcatgcgtgactactcaaccgaactaaaaagtgaaatggcggcccatcctgattaccagctactcctacatggcttgctagatgaagacatcctgaatcgctacgttaaactagccaaccagcagcacatcaggtttgcgattcgaaatgacctcatgtaccagcacacacctacgagcctcgccatcgccctagtcgccaactgtgccatcacgccaccgacaatcgatatcgatgaacgttttcccgttccgccacttaacacaactaccgattggtcgcacgacgtcctcatcgatcacattcaccgtcatctggaacgcaatcgtcaactcttcagcatcaaacaccacttaatctaaccagtgtcttactttgacatctattgtgcgtgttgacatgaattatggttaaaacaaactgtttaactgcattattttccgtcagccggtgcgcgtcctatgccgacctccggggctgggtgccaattgcnnnnnnnnnngcaattggcagaaatgcctggaagtcggtgtaggacgcgccaactaagcaattttacgcttactcgacttttttccagcgggcctaagctggttgcttttgatttaaaaaacagtccgttttaaccatatttaatgccaatctctcaaatcgatgcattatacacaaagccaccaacttaaaatgatcagctttcactgattgtcctaagttggtggcttttactttatcaatcaaaagacttaattgacttcaccattggcccactagttaaaataattgcatcacgctaattacgattggtggcactagcaaggctggtaataggttcaacgtactgaattgcttgattttcaacatacctaagccggatgctagaatcaagataccaccaacaatggtaatttcattcagtaacgctgcactcaacgcacctttcaaaattaatgctaaaacatacaggctcccctgccaacaaaacaagacgcccgccgcaatcgcgatgccaaatccgaaagtggatgctaatacgatcgacgtgatgccatctaacatgccattcgtaaacaaaaaggtgtaatcatgctttaaggctgcctcaatcggccccaaaatcgataacgatccaatacagtacagtaacaccgcagtcgctaggccttccgctaagttgccacccgccaaacggcccacccagcggtcaaaatgcccttgaatatccaaagcttgaccaattaatccaccaatcgccaagctcacaataaaaagcaccgggtacttactctgcggcatccgttgcacgaccgcattaatgccgatgacacaagccgctagccctaacgcttgtaataatatcgcatggtaagctggcttgattccttttttaaagatactgccgaccaagcaaccagctaaaatcatgctcgtattaaaaatcgttccaatcatatcgccactcctaatcaatagcttaatctctagcgcttatttcaatttaaaataattaattatcatttagtataaagtctaaagttacttgagggtcaagtcttgattggtaattgtatctgcgtcaccgactgtgcaacctgatctgtaatcccataatcaatcagtgctgtctcaatagctgttcccgccacgtgccagccgcgagcacgacaatccgctaacaattgtcgatactgcatcggggcatccaaatgagtgccgtgaaaaatccgctgcgcatagctaccagccgccaagtgttcttgatggggtggcaccgtatcacccggttcaaataataaacaaattcccgcatagcggtcaaaatgtccggcttggatggcttgctggtcgagcatcagcgcaaccttgccgagaaagatttcgttcgtcgcgccggtctgtgcgcgtagcttagcaataacaagttcaatatcatcttgagggcgataaggctgacgtaaagccaccatcgctctttcaggtaacgtcacgcattcagtcacatcaaaattggcactttgggccgttttaatctgggccaagcgtgtattgatccgttgttgtaccgccgttaataatcgcaattgcgcctcaacctgctgctgttgggtcgttaacatactcgtcagcttggacagttcacgggccgcaaaaaaatcggcaatcgtagccaatggtaagccgagtgctcgcaaatatttaatggtactcaaccgttcgaactgaggcgtcccataatatcggtagtgactatgcggattgactcgtgccggcgtcaataacccaatctcgtcataatagcgtaaagtcgccactgggatatcaaataactgtgcgagttgcccaatcgaaaaatcagttgtcatccgatcgccatcctcccctataggtcttatcataacttaatcgctgaagtaattgctgtaaccagaataagatatcataaaaaagttgcatttcagaaattaatttctgaaatacaacttttgggtctatcaatcatcagtgatcatcgccatcgcattattaatgcagaactaactgacagagctgttttcaattatttcgtaattgcgcgcgcatgccccgcccgaatctcagctaaatactgatcacttttggccgtatcaaattcatgttctgacttaccgataattaccgcagctaatgaattgccgaccacgttaaccacggttcgtcccatgtcaactagccggtcgattcccgcaataaaagcgagtccttgtactggcacgccaatcgttgaaatcgtcgccaataagacaacaaacgaagcccccggcacaccagcaatcccctttgacgtaatcataagtacaatcaataaagtgatctgctggctgagtgacaggtgaatcccataagcctgagctaagaaaagcgccgctaacgattgataaattgcggagccatccaagttaaacgtatacccagttgggatcacaaatgagacaattccttcactaacaccgtatttccccatcttatcgataatgcggggcagggctgcttcagaactcgccgttgaaaagccaagcaccatttcatcacgaatgacccgtagtaagtgccaaatatttaaaccgaataacttaccaacaatgcccatcacaaccacaataaagattgccatggtaatataagcaagaataatgaaatagcctaacggggccagcgccttcaagcccatttcagcgaccgtgaccccaattaaggcacagacgccaatcggagccgtgtgcatgacccagttcgtcactttgaacatagcttcggcgacagcgttcataaagtccagaataattttgccttgttcgccaatagccgccgtccctaaaccaaagaaaacggcaaaaaagatgactggaatcatgtcaccagctgacaatgatttaaagacgttagtcgggataatgcccatgaccgtcgaccaaataccattgtgtgagaccgtcttagcggtttgcacatactgactaatattcgacgcatgtagttgatgaatatcgatatagtcaccagggtgaaaaatgttacccattaacaaccctaaggcgatcgcaatcgtcgtcatgatttcgaaatagataatggttttaccaccaatccgacctaactttttgaggtcgcccatattagcaatcccggtaatcagacatgccaccacgattggtaaaacgatcatttgaatcagactgatgaacatcgtcccgatgttttgcatcgcagtaattgccgttttattgccataaaagacgacccctaatacaattccaagcactagcccaattaagatctgccagcccaagctcaatcggaactggcgataccgcttcatctttccctgcttttccaagctacttccgccccattctcatttatggatgtttttatgaaatattgcacacaatattaatattttagcacattttcagtcaatatgagaattaaattaaaaaatcaatcattaaaatcaaatggtcccattgtaatagacgttaatctcagttgctttcctcataatcacgtgattgtcgcggtgaatcactatttccgttaccatcagaatccgaacattaaccaaaatagcgacaattaaaactagcttggttagcagttgtaatcattcctaaccaagctagttttttaagcaaaaactttattcaacggttgcgattacgacacttcatcatgtcgtcactcactaaccgatttaaaccgctatttggaacgggtcatccggtcatagacagcggcactaacccaatcagcggtccacatccataaaacatgcccaatggcttctgacacgtgttcggtcattggttgatccttcgcagcgggaacggttcccagtgctggcaagataccatggtgaaaggctgtccagatacctaacccatacaacgcgctgctgccaccttttgcccgggggtgcttgcgagcccataaactataggccacagcaaaggtcgttgagaatccgaaatgcatgacatagctgacacctggtaaatcatgaccagaatatgaatacgttgcatgcgtaacgctggcgggaatcccaatttgttgcaataattgttgtgggggattcgtttgatcccgctgtggcgttcgtggcggtaggatattctcccaccctaacttaactaaaccagaaatcacaccaccagtcacaccagcaataactgcggcccgatgattgaactgcttgttcaccattaataattacctgcctctctattcaataaattaatcataccagccttggtacccatttcgaaataatttagcctggtaattaaataaaaaatttgatttacaaaaatgaacgtgatacgattaccacatttatttatcacttgataaatgaaattaaaagggaggaattgacatgtatttaggcttaaaagaaatggcccacgaaaaactcagatatgggctacttagcggggttttgctactaattgccctcgtcgtctttatgttagcgggccttgctaacgggttatccaatggtaatcgtcaggctgttgaccagtggcatgctcaaacagtttatttgaacgaagatgcgaatcagacactgtcagcatcccaattaaaactagcagaccaagatcgaatcaaaggtcaggacgtcgcacccttagctagtctgtccggtactttacgaactgccagtaatggtcaaaagactaacgctagcgcttttgggaccactcgcgatagttttctgatgccaaaagtcatctcaggacaccgaatcaacggcaagaatcaattattgatttccgcgggattaaaagacaaaggctatcggattggtcagaaagttcgcattgggaccactgatcaaaaggtaacgatcgtcggtactttcaaagctagtacctatagtattgcgccaacggtctacacggacgttgccacgctcaatcgtctcaaaggtaatcccatcaccagtggcgatcaacaaccggtcaacgcctttgtgactaaaaagagtcatttcaagactcaacatcatggcaacatgcaacgtttatcaattgccacgtttattgaaaaattaccaggatacagcgctgagcagttgacactcaacacgatgatttacttcttgttcgcaattgccctagccgtgattggaattttcatgttcgttctgacccttcaaaaacaagccttgttcggggtcttaaaagtacaaggtattggtaccaaacacatcttggctgccctactcacccaaagtgtcgtcatggcaatcattggtatcggcatcggccttctaattacgttaggcctcgcgcaaatcatgcccgccggattaccattcgccattgactggccacaatttggtatttatagtgtggctctcttgttagctgcagtcgtcggtgccttactctcatggcggactgtcgccaagattgaccccgtcgttgccattggataaggaggatgatatcaatgagtcaaccagttttagccttacaaaatattaataaacaatttggtcacggtcataccgctgttaacgctttgactgatgccaatttcgaagtcagtgctggccaattcgtcgcgattatcggcccctctggctcaggtaaatccacctttttgacgattgctgccggtttacaaacgccaacaagtggtcaagttattctgaacggacaaccactatcgaatcaaacggaaaaacagcgcttagcctaccgtttcaatgaaattggctttatcttgcagagttccaatctaattccattcctgacggttcgtgaacagttcaagctcgtcgataaaatggcccggcgcaaatttgatcaagcaggcaccgatggattactagcagagttagcccttactgaagttcgggatgcctacccaagtgacctctccggtggtgaacgccaacgtgttgccatcgcccgtgctctttacaatgatccaagcgtcattctcgcagatgaaccgaccgccagcctggacacgccccgctccatcgacgtcgtcaagcgcctcgccaacgaagctcatcagcaccaaaaggccatcgtaatggtgacccatgaccaacggctgattgatgactgtgacgtggtctatcaaattgaagatggtaagatgagtcgccgcgactcgtagtgccactgaccactgcactttaacctcataacagtaaaaatgacctcgccaggaatgttcctgtgaggtcatttttactgttcatatttacacgactcatcagacactacgaatcgaaaactagaatttgccaagctcaaagacagcctgcttcggcccgctggaaaaagtgcgagttagcgtaaacatgcttagatttagtcatccgacaccaagtcatccgttcaactaattagcttgcggcaatttatatcgcaatgcgcggtaaacaagtgcgaccacgtacactgtgataaaccgatctaaataatccgttcccacttgtatcaagaagacggccatcgttttgcccataccggtacctaataataattggactagcatgctcgaaccagacgacgtgatgccatgaaataagatgaccgtaatcgccgtggataaaagtgttccgggaagtgaaataacaccagctagccaccaatttgaccgccacgtgcccggcttgattcgccgatatagcagaccagcaactaacccagtcagcagttgaacgggcatgaagaacagcgagtacaggtctgtcgtcgcacccacgataactccggtggcacccccggccaacattccacccagtggtccaaacacagcagcagccaaaacggtaccaattgaatctaaataaatcggtaattttaacatcaaggcaatgttactgccaacaatattcagggcaatgcagagcgccaataacgtaattgcccgcgtttttattctcttcatgcactcaccaattggtgcaagacttgcgttaaatcaggatcagccgcaccgaccacagtcgttaagaacaaccgccaaaaagctacgacgtcaaccttcgtcatgatttgactattgggtgtgttgtgccagaaatcatgatcatccacgattgactgcccacgcgcgacaccatccgtcacaaccgtcgtgtagctttcaaagccactcagaatcgttgggtcaagcattccggccacggccaacggatcattgatcacacaaccaataacccgttcatattcccaatgaaagtcaaaataaaaggttgtaattttctcaacaaaagcccccattgctggattgacgtctttaatatacgttaataaactgggtgtcaacacgatgttacgcgtgacgtctaaaccaaccatctgaatgggaacaggcatcaagtcaaagacgaccttggccgcatccgggtcacaccagaagttgtattcagccactggcgaacaattaccgtgactccgataacttccacccatcagtgtaaattgatcgacttgttcaaataagcgtggatcacgttgcagtaccgttgcaatgttcgtcaacggtcccaacgctaaaatcgaagtatcaggtgcttcaatcagcgtctcttcaataaaaccagcggcatcttgaatcggtcgtaccgccgttaccgctggaatctgactattccctaaaccatcatcgccgtgggtgtcttgcgcactcgtgtaggcgacttccaatgggcgattagcgcccaaatagactggaatatccaatcggtcagccaaatctaaaattttcagtgcattttccgcaccgatatgggttggcacgttcccacaaacaattgtaatcccaatcacattaagtgccggtgatttaagagccaataatagtgctaaactatcatcgatcccgggatcacagtcaataataacgttacgcgtcgcattcattctcttacctccgataactgaagttcttggttttttatcctgggaagtttacgaaccaggccagctcgcctaattaggtcaaactgtatgtgatgaaatgctaatccaattatagcggacggtggggcccttgaaaaccaccaatcgttacttcaactcacatcttgattgcccgtatgctacttctccgacaatgatcaccacgacctgctcaacccgctgtggatactcattctcattagccccacaacatcattatttgcagcattcatacgctcccagcgacaccttaagtagtttcccacctcccatttcgaaccaattatttaattgtgttactgaacttttaccggagttcagcaagtgaatgaccggaaaacatggtacaatatgactactaaagataaagtaggtgtcgaatcatgcgtaaagttcagttttatggggccatttcaattgacggttgtttagccactaaggataatcggctggactggctgttcaaaacagctggtgccaacgatgcccccaccgaagcatttatgcagcaagttgataccgccatcatgggccgccatacttacgaatacacgatggaacaaaccactgatcaactcattaatccatataatccggcgacccacaatattgtcatgacttcccacccccacaccggcgatgaacgcacccagttcaccaatacccccgtcacgaagatcgtcgaagacttgcgccgtaccgctggcaaaaatatttggattgttggcggtgctggcgtcttaatgccgctgttagctgcggatttagttgatgagctctacatccagattgcaccagtcattttgggtgatggtattcccttatttaaagcaattgaccagcaacagcgctttgaattagttgacaccaatcgatatggtcagctcgccgaagtccactatcaacgtttaacaactgaataatgtcgtgattaaaaaatcccagcccgtttgcaatacgcaaacaagttgggattttcaattgctttaagcttcacgttggcgtttaaccgcctgacgaagtaatagtggtgcaatcagcgtcgttaaaatgattgccgtgatgactgccgaataacgatcagctgatagtaatttgccttgataaccaatctgtgcaatgatcagggccatctccccacgtgacaccatgccggcgccaatctcatagccgcttaaccaattaaaacccgctaaccgtgcgccgcccccggcaccaatgagcttagtggcaattgccgcaacggtaatcacaacgatgaaccaaaaatcgttcaagaaaccattgaatgacatattcagcccaatactaacgaaaaagactgggataaatacagcattaccaatgggttgaatatgctcatcgataacttcatgatagtccgtctgaccaacggcgataccggcaaaaaacgcgccaatcacggcacttaaaccgattgcgtccgctaagtatgagagtccaaaacaaatcactagtgacatcagcgtgatggatgttggaaccagtagggcatgccccacggccattaaatgtggcactacccacttgaccacaaagtacagcgccacaaagaacgccaactgaatcgccagcgagagtcccaagttggttgaggcatgactaccgccaccactgacttcactgccaaataagctgatcatcaaactcagaatcaaaacagccaggacgtcatcaacgaccgctgcacctaaaatcgtcgtcccttctttaccatcgagggcgcctaactctttgagaaccgcgactgaaatcgaaaccgatgtggccgcgaaggttacgcccaagaacaaactttcagtggcgttaaggtgaaatagttggctacaccagtcaatcaccgcaacgggtagaatgacccccaggaccgcaactaacaaactaggacgccaatacttcttcagcaatttcaaatcgctctctaagccggccatgaacattaaaataatcacgccaagctccgcgaagtctttgataaaacttgttgctgagacccaacctaatacggctggaccaagtataattccacttaacaattggccaatcaccgcgggtaggcccattcggacactcaggtgacccgcaaccgccgtaacaattaaaatcaacgctaaactaccaacgtaatccattaaaaacctcctaaaaaagggcactgcaagctctgactacccaacccaaaagtagtccgaattcttgaagtgtccttcaaccgtaaaatccattgtgcaattagtatagcatatttttatgagtctagccgtgacatctacttatgaaagcggttataataactcatatactgttaactgaaaggtcgcttagtcgtgttgaacattcctgattttcgtcaacgttttggttttttagtcttttccattattctgaattctgctgccaacgcgctcaccatcgccaccagcctaggcagcgccgtctggactggctccagcgttaatctagctgactggacccatatttcattaggaaccaccttattactgtacggtgtggttgtcacgattctcaaccaacttctgttaggtcactttgatcggcggcggtttatctccaacttgctctatatcgtgccctttagttacctggtccaatttatcggctacttttgggattggctacagattcccgccctgtccctgttaccacgcttaattctaaacgtgcttgggctattaggcgttgcggccgccgtctcgatttaccagtgttgtaatttaattcagcatccgaacgatgatttatcatatatcttacgctttcggtttttacatggctccgctattattgctcagtggaccagttatttgccacctctgacgattatcgtcgtttcattcttcgccacaggtcatttgcgcgccattggcttcgggacggtctttgccttaattgctcaaggtgccatcatggggtggtctgatcatcatgtttttccccatctcaaacatcacgtggatattgtccaggcgcatcatccggcctaaatgaatcttgacaaagttcaggccaagcctcaataatgagagtattctaatttattggactgaagtaaatgaatttaacgcaactaactagtcaaatcattttgatgttcattctcatgctcgtcggcctgctcgttaacaagctcggcttcatgcatgcccagacttcaactgatttaaccaatatcctgttatacattgtgtcaccttgcttgattattcaagcctttgaaaagacattttcagccgaccgcttgcaaatgttagcccgggtcattgctggaattgtgatcatttatgtgctcatgatcattgtgacacaattactattcaaacgcgtctctgaccagaatttgcggcgcattatgcgttacggtgccgtatattctaatgccggttttatggggattccattaaccagctccctattcggtgcaactggcgtattctatgctgttgcctcgttagcggccttcaatatttttagctggactcacggtatcaccctcttcaccggacaacagggcaatcggcgggataatcttaaacagatcgtctttaatccgaatatcatcgccattgttgttgggctactgatcttcgtaacctcgctgcaactgccaacgattgccaatagcgctattaaatatgtcagttcggtcaacacacccctgtccatgatcgttattgggaatagtttggcagacgttaaacttaaccgtgcaacactcgataaacgtctttggttagtcatcttattgcgcaatttattgtttccatacttggcgattgttgtcctccagctaatgggtatcactggcatcccattattcaccacagtgttaatggctgcttgcccagtcgccggaatcgtcgtcttgttctcgctcaaagtccacggtgatcccgggccagccgttgccctaatgagcatctcaacgattttaagtgtcgtcaccattccaatcgtttttgctttggtcaacttacactaatgtgtctcactgcttttagctaagactaagtaaacgacaactaaaaatgagccatcagaatttttcattctggtgactcatttttaatgactagcatttgagatacggcttaaacttggatccactgcgttttagtaattggcagaaagcgcgctaactttagtttgtgctaagtcgtgcgacgtccattggctttaaactggctggtgtcaaccttcagcactagcctatctcagccataaattgcactgcaaaacagtggctactttgcaaccgctcgtagttgttcaataacctctgggcgtggctgagttagtccggccggcgaaaacagctgctcgaccaaagcatcgctaagcaagcgacgtcgatgtaataattcaggaattgcttggttagtggtgagcgcttctttaatcagcgcggtagtcgtctcgtaaccaaggtatggcgccaaaacagttgccgtaatggccgaatgtgccacttgatctgcacagcgttggcgattgaccgtcaattgccgcacacagtgatcgactaatgtagtcaaggcctgctgtaaatgctgctcactggttagcaatgcccgtaacataatcggctcgaaagcgtttaattccaattggcctgcttccgctgccattgttaccgtcgtgtcgtgaccaatcacttcaaacgcaacttggttaacaacctccggaataaccggattgattttacctggcataatagaagaacctgcttgctgcgcgggcaaattcaattcaccaaagccagcttgtgggccgctcgccagcaatcttaagtcattgctaaacttggaaaggtcaacggctaacgtcttcatggccgcagagaattccacgaacaaatcgcagttttgcgttgcatcgatcaagtctggtgcggctactaaatctaaatcagtattttgatttaatttcactaaaatctgttgttgatacgtgtgagtcgcgttgatgccggtaccgattgcagtcccacccaaatttacgattcggagatgttcgcccgcctgccgtacacgggtcaaatcacgcttgaataattggtaataagcatgaaaggtccgcccgtacgtcgtcggtaccgcatcttcaagctgagttcggccaactttgatggcatcttgataacgctgcgatttaaccagtaacgtttgtaccaaccggctgagtgccgttaatagtcctgggagttgcatgcaaagcgccattttaccggccgttggaaaagtatcattggttgattgtgattgattaacatcatcgttgggatgaacggcaactgccggcatcaatcggtgagccaaattagccaccacttcattgacgttcatgttagccgaggtcccagcacccccctgaatcgctggcacaatgaagttatccgcgtaacgccccagtagtaactgattacatgccgcaataatggcgtgtgccttatcattagacaaagttccggcagccgcattcacactggccgccgctttcttgatttgaacaaggctttgcatgatcagtggatgcatcaattccgtcgtaatcggaaaattatgaacggcacgtaacgtatgaattccatacaaagcatcatccggaacagctaacttaccaatacaatcagcttcaattcgcatagcaaaaccctcttatttagatttcatgttacatcttctaacatgaataattagagtttagaccattttctctgaaatacaatccttttaattgatttacgactaatattaagttcaacgccgattatggttaatattcattaagctcatcatcagcatacttcatattaattaactgtcccctactgccagcgcctataccaatcattaacacgacgaccgctaacccgcagacgccgttccaaccagctaaatcccataagacgttgccacaaaatgaacctagggcgccacccatgaagtagccaaacatgaataccgaattgaaacggctactggcatggacatcgatgctttgaatccgtgtctgattcgcgacctgcccgaattgagtacctaaatcaagaatgacaataccaataattaaccccaccaaatgcgtaccactcagccaaaacactacgtaggataatgttgataacactagacccaagccgataatcgttcggggccgaaaacgatcagctagacggccaattaaaggggctgctaacacaccggtaacacctagcaacgcaagcagaccagcttcacgacttccccacccgtattgatgttgcaagtaaaagacgagtgttgcccagaaaatattagaaacaccaaacaagacaaatccgttaacagccgacgctcgcaaaaccggatagcgttttactaactgaggtactgtctgaatcatggctttataattcgtggtatgtgtcgtcacgggatcatgcggtaattttcgccacaagacgagccacaatcctgcaatcaagatagcggcaatcagatagaccatctgccaaggcaaatagctcgcaagtaccccactgacagttcgtgacaagagaacccccacgagcaagccactcaggacgttgcccaagacttgaccacgctgattacgaggtgcgagaaagccggcgtacggaataataacttgtggtgccaccgaggttatcccaatcagtaagcttgccaaggcgtacacccaaatattgggagccacgaaggctagtaacgctgaaatgattgcgagtaccagtaagcgcataatcaacattcggcgattcatgatatcacccatgggtacaattaagagcaacccgaaggcatagcctaactgcgtcagcattgccaccgcgccaataacggcgtttgggagattaaactgttgcgcaatgtccgcctcaatcggttgaatataattaatattagccactacaatggccgcggagatcgccattaataggaccgtacttttatttaaagattttgaattcacgttaatttcctttccaattttgagatttaacagcttagtcaaaattagaaagcttgttcagccctgatgatcaaccagtgttttaactgttgatcaacggggacactaccgcgcacgcctagttaacccactgcttagcagcggccaaatcagtaaccatatgggtcggccgttcagaactagtcggttgtcgctgatcacgattaatccaaatcatcggccactgcatagcactggctggaacaacatcggattcatagccacgtgcaatatgccaatgattatctgccgttaacttaaaacgctcttgaaccgtttcaaagaaagctaacgctggtttgtaagcttgaacgtcttcagccgtaacaaccgctgtgaacggcacctttaaagcagcaatgttggccggcataatatcccaggaagaattcgacataataatcaattgatagcccaattgctgccacgctgttaaggtcggtataacatcggcgtatggtaataagtgtcgttgcacttccaagcattcaacgtaatgactttcaaagaagtgtctctgttcaaacaatcgatctaaatgcttaagatcagcccggactaatgttgaataatctagataaggattgacactggcaggatcgtcctcataagtcgcgtaggctttgcgaaccgttagtgggtctaaaccaaccgccaatcctaaattagccacccattgatacagcggctcagtattaattaacgtcccgtaacaatcaaatgttaaatattttttggtcatattttttagcttccttactgaatgtcgatgaattgtgctgactatcattagcacgactcaccacaaattaactaatattatctattttattttaccacgacaccgaacactcagcagaccgccccggtaccaattaataggactaggacttgcatcgtgatatacttattgattgtgcatcattacagaatttataaaagaaaggacggtattatgccaactcaaaattcaacgttgccgcttgatgccaacggccagccctatcaccggacttggcttgtattgactttacttgtcgggacgttcaccaccttcattacccaaacactattaacgacagcttttccaacgttaatggccgattttcatatttcagcaaccgccgttcagtggttgaccactggtttcatgttaatcatgggaattatgattcccgtcagtgcctggttgctgacccgaatcaattccaagtatttgtacttaacagccatgcttatttttggtctgggaactacgctggcgtactttgccgtcaactttcagatgttgctgattgcccgaatgattcaagcaatgggcgtcggaatttccgccccagtgtttcaaacaatcatgtcttcagtttatccacccgaaaaacggggttccgcaatggggacagccggaattgttattggcttagcacccgccatcggaccgacactctctggctggattattgataactattcctggcgggcactcttcttattcatcctgccaatcaatatcctagtcatcatcgtttcattcttcactttgcggaaagtcttaccaacttccaaacaaccaattgattggtggtcagtcttgatctcaacaattggttttggcagtatgttatacggtttttcatccgttggtaatgctggttggggcgacccagtcgttctcacaactttagtcattggtctgattttcattggtctattcgtctggcggcaacttcacatggatcagccattattggaattacgtgtctttaagattccggctttcaccctatccgcaatcctgaccgtcctcgcttacatggctatgatgggcgtcgaaatgattttgccaatgtatattcaaacggtcctcggtcgttcagcaatggactctggattgattttattacctggcgcaatcatgatggggattatgagccccattactggtcgcatctttgaccatatcggtgcccgcagactagcaatgacggggatgttactcctaacgcttggaactgctttcttcctatcaattagcgccacgaccccaatcttatggatcatcgttgtttacgccattcggatgtttggcctgaccatggttaccatgcccgtcacaacgaccgggatcaatgcgttacctttccggctgatttcccatgggaccgccgccaacaacaccctacgtcaagtcgcagcttcaatggggacggccgttttaatcagtgtctactccagcgtcgctaagtggcaaatgccgggacatcaattactgacacaggcacctttgaaataccgtcaggacggaatcaccgcaaccttaactggttatcacatggcgttcgttgtctcactcattttttgtgcgattggctttgggattaccttcttcttaaaagccaatcattcaaaaaccattagtcaggaggatgatgccgcatgatcattgtcttactaattctggcaacctttgtctttgctggcacgatgattttttcaccggcaggccgtaaccgtctcattgccattatcattagtggcctcattattgccactagcctcatcgccctcgtcctaaacgacaattaccattggggcatgcacgaggtcacccgcacgcagattcaagacttagccccgctaaaatccaaacaagtagcgttgcgggtccagcaactcggaacagggtctgaacgcgtcatcagttaccgggttgcagccgccactaaagtcagtcacacggtgaccgcaaccaccacaacaactaaactgactagcggttcacccgcgcaggttcaactaaagaccacgacttggcagttcaaaaatcacctgacacacgtgttattcagcctaggaaataccaagacaaaaattgttcaacgccaatatttgtttacaattcctaagacgtggcaagtggtgacagttaaaaattagacgttaataaaactgactaaccatcttggctagtcagttttattttgtttaatcgtcatcacttgtggcgcttcgccagccaatcaaccgctgaaacctgatacacattctcatcatgatcgccatccaataagtgctgaccacctggatgctgaatcaaaaagtcaaagcccgtccgttgcgccaccgcattgcttgcctgattgtccaccgccgcacgaatccgcaaacattgccgatgatactgattaaaacccaagtcacaaacgccacggacggctgccgtcatgacgccgcgtccctgaaatggtcgtcccaaccaatagccgatgttggcactgtggtcgttatcatcgaagtggtcacagctaaccattcccgcaacccgttgttcaacgacaatgactaggttgagcgcttgcgcttgttgtaactgagcttgtgcaaaagttaaaaagcgttgttcatccgccaccgtttgaattttagccacccatggcaaataatactgatactgcgcacgattagcggttaataatgctagtaatgccggcgcatcgctttggggtagcggttctcgcaattcaatcgctggtgtgactcgataagttagcatgaacattcctactctcttagatgaaaaatcgcaatcatgattaattgaatgattaaccatgattgcgatttaagtgtatcaaaacccaattaatgttgcagtaataacgtaattaaaatcaaggcgctgacgacctgaatcgtccccacgcctaagccatacagtgctaagcgcttgccagctttcataaagttaacaagattcaaacgtaacccgatagctgctaacgcaatgatttcaaaccaactactgattgtatgagccgttgcgccaataattgctggtaacgaaatcaagctattcaatgcacataagattaagaacccggccacgtaccatggtaaccaatgaccgttcccattaccactgacgacagcatcctcagccaattcattttcaatcgtgcgttggtgtaaccggccaaaaatcaaaacaacgacgactagcatcataatccgcataattttgaaaatcgttgcaaattgaaccgttgtttgattaatcatactagctgcggccactacctgcccaactgattgtaaagttcccccaatcaacgcccctttaagaatgacactgccaccaaacacggccattcctaagaccggtaacgttaacatcagcactgtccccatcaagttaactaaggtaatgacagtccccttatcatcttcatccgcgtcaataacgggggcgattgatgcaatcgccgacgacccacacacggcgttaccgccggccatcagcatacgtaccgactggctgaaacccagcttacgccctaaccacaaagccccaacgatcgtaatcgtcatttggcaaagaataaagagcacgccgaacccaccaattttgccgattgtctgtaccgtcatcgtcgcaccgagcaacatcacggaatattccaacagcttactttctgcgaacttagtcccccgaccaagttgcggttgtttcagaaacgtattgccaccaatgattcctaatagaatcgcgatagtagccgcacctaacgctggcacaaattgcgccaatccttgactaataattgcaatgaccagactggtcactaaccccggtaaaatccctttgaccttcattcactttctcccatctctatctcgatgcttttaagtatacgaaagttatttacatttgagaaataaattattatgatagttattattaataaacataatagttaggggtgaacacaatgtttaaacaattggaaacgttctgtgcggtatacgaaactcgcaacttctcccatgccgccgagcaactttttatttcccagccgaccgtctcaacacaaatcaaacaacttgaagccgatttacaaaccacgctcttaacacgtaacgggcgccaagaaatcgttcctactgccagtggtcagctcctctatcaacaggctcaaaagctgttaacaacttgggccgctaccaaaacagcggtgcaatcaccacgccacttagtgaaagttccttgccggattggtgcctcacacacaaccgggcgtctgattctacccactttattagccaatttgagtgccgtcagtgatcgctttgactttcaagtgacgcttgccaattcggccgaaattttgaccgctatgtcccaacacaaactggactttggtttagttgaaaagccactcgttactgaccagctcaatcgcttgccatttggtcacgatgagctcgtccatgcgggcgactttgccagtcccctctggctgctacgtgaacctaattccggtgtgcgtcattataccaacgcctttttaaaagcccgcaacattcagccagcacaagtcatgatcatccacagtaaccaaatcatcgcggacctcctcgctcatggtatcggccaaacaattatttcacgtcacgttttaagcaacgagattcccatcgaacagctaagtgctcattaccaacgccaattctttttactgactaacacgcaaccggcagcggcactgcgccccgtacagactgcaattacccagtacctaacaacgtggtcagattagcgatccccgccgttgttattaggtctttttgacattagcgtttaaaaaatggtctgaccactaaagtcagaccatttttgatattcactgaacaaccggctgccactgttgccaaacttgttcatcactatattgttcactactccgataggcccccttgctaagtcgttgctgacgttgcggactttcaagtgttcgggtcagcgctctgactagttggttgacggcaccatccgtgaccagataaccattcttgccatccttcaaaacatccttagggccatagttaatatcataagcaattgctggcacaccatgactaagggcttcaattaacgataatggctgtgcatcactttcaccagtataaacgtaagcaccggcctgatcataagccattgttaagttcggttgatacccagcaaaagtcacggcggtctctaggtgcaactgggacacttgctgttttagacggtcaagctcaccaccatacccgtaaatcactaaggtcgcatccgtaatcttatggtgcacttggtcaaaagctgtcactagctgatcgacgcgccgttccgcatccaaacggccggtataaataatttcatgcgcatgacgttcactgatcgaaattggtgcgtgttgagcgtgctttttggaaacaatggctgctgaaatcgtcaggattgggacactcggttgaccaccgagccactgcgtcaaatcttgcttctgttgttcggtactcgtaatcacaccgtcccaagcactcagaaactcgtgcaggccataaacatacgcgttattcaaattagaatagacttgatcacgcggatcgactgcatgtggcgtgggtaaccacaaatattttttagccgccgtctgcatgttcaccaccggccactgagcagctaacggccgatccgcaataaagacgttgttttcatcatattgcttgttcagttcatctaagaagaaccggtaccattcttgttcaccattaaagtagtagtcacggccatgataattgataagatggcacaacgaaacataattagtcccattattatcatgcgcataatactgttcggccatccgactaccatctggtcgatagaaaatatccgtgattggttccccggctgacgagaagaattcatcacgggccttaaagccccgttcatcataatcagtacgctgaacaagattattgaagtgatcaaaaatttcaatgaagtacacgtgccccaccgtgctgggaacaaagtggaccttagcaaccagccgatcaccagctcgtacctcactgacattggggtccggcttaatgtcataggcagttggccagttcaaatcagccatcttgatgacccgactggaaaagctggtcgtttcacgaaaaaagtcaaacaagttggccatctgatcatcggcaatattgaagcgccgcatattctgatgtaacaaaccatcgaattgacgcgttactagtttagccggtgcctgatgatctttaaacaactggagccgtttaaattcggcatgttccacaccagaatttaacgccattaaatattggttcacaaaaaaattcatcgctgtgttgccccctcaacttgataaaaatcggctgcggctttcatgagtggttgccactgttgccaaacagccgttgtgctaaagcgttgggcatcttgataagcctgttgactatacatggctaactttttcggctgcgttaacaagtcgatcatcgccgtagccaacgcattttcatcattgaccggcaccaattgaccatcgtgaccgtcccgaataatatcacgtggcccatatttgacatcataggcaatctggggcaccccgtgggcctgaccttcaagcaaggcaagtgcaaaaccttctgcccgcgacgttaacatcgccaactgcgcatcattatagacagctgttaaatcggtcgtataatcattaaacgtaactgccgctttcagtcccagctgttccacaagttgatgcagttgtttgccggtatctccatttgcatagccccagaaatcaagggtcgcattcggcacttgggccaatacctttttgaatgcccggatcacctgatcttgttgcttttcttcggctaaacgcgccacaaaaataatcttgcctgcggtgcgctgatcaaaagatggcttgggcgcattcaaagtcgcgtcatcgacaatcccaactggaatcgtataaacggcgggttgattgccaaagcgggcttgaaagtcagcagtttgttgcttagtcgacgcaatgacgccgttccattggtctaggttattgagcgcgtaagcataattaaagttgagactagccgtcttcggatgtgctggatcattaacgtgattactgtgtaagtgcatgactttaaacgctttagttcgcatgtgaagtgcggcgtaagccaactcatacgtccgatcaatgacaaagaccgcatgcggcgtcctccgattaagttcatcgaggaaaaaggttgtcattgccgtttcaccagcaaatgaccagtcttgcccctcataattaatgaatcgataaagtgaattttggacctgattttgtcgatctgccatatgaaatgtctgatagacgacctccccgtccggattaaagacttgttcacttgccacttgtccatcagcggcataaaactgttcaagccctttaaatccccgggtatcgtaccaatcagtcttcactaacttaccattttgatcataatattggacattgttcagttgtttttgagtgttcagaaatgtattgaccttcattaataactggtcattttgataaacttcataatgacgcccaacgggttgcacccgcaagtccggtgctagatgcagatcttcaatcgtcatcttagtcgttggccgttcactggaatgctgaatgaaatcaaacagattaatttgattttcagccgcaatccccgctgctgtcagtgtctggtgtaacgataatgaaaaaaatcgcgtgaccatcttagcaggaacgtgatgctggttaaaaagtgccagccgtttcatctcagcatgttcaattcccgattttttcgggttaatgctggtattcacaaaataatacattattactcgctcccttacacgacgttctgcttaacggtctcgattataacaaattttactgaattaataagaatatcgctcaccgctttaaagtattttttaagttactttctgaattttaccgcgagtgtgatgataatgtggcgaaaacatgatgaaagtgttaacttgttacaccatgttactttattacaaaattggctcaaaccgtaatctgttgtttattgctttgcaatctgtgatcagtatactaatcaccattcaatcgaaataacaacacaacttttataggagtgactgattaacttatgaaaattaaaaatgccctattaacttcattggcagctaccggtctgttagctttaggtactaccgttgctaatgccgataccgttgtcgttaaagctggcgatactgtcagtgaaattgctttaacgcataagacgaccatcaaagcgattcaaaaagccaaccatttaaagaacgttaacttgatctatatcggtgacaaactggaagtcaacggcaaacaccacgcaaccacggctactgcccaagtaccaactagtgctgcttcaagtacggctagttcgaccagtactgccagttcaacgaccaacagtactagcacccaaagtgccagcagcgcatccgttagcagcagtacaagtacggcagcagctagcacggctaccagttcgtcaacgacaagtgtcgcctcaagtagtgctgccagctcatcaagcacaagtgctgcttcaagtagcgtgaccagcacgtcaaccgccagcgcggcctcaagcagtgccaccagttcatcaaccagcagtgctgcttcaagcagtgccgccagttcgtcaactagcagtgccacttcaagttctgcgacgagccaagctagcacggcgtcaagttcaaccgctacttccgcatctatgacgaagttgagtaacaccactgcttccagtgccgccagcacaagtacggcagccagcagcagttcatcaacaactagcacatcaagtagtgctgaagctgccgcaaaagcttggattgccaacaaggaatccggtggctcctataccgcatctaacgggaactattatggtaagtatcaactcagcaagtcacttctaaacggtgactactcagcttctaatcaggaaaccgtcgctgacgaatacgtggcttcacgctacggttcatgggtagcggccaaggccttctgggaagccaacggttattactaaacacattcatgcacaactgaacatacaatcagcgtgatcctatatggggccgcgtttttctgttgccatataggtgcaccggacttgcctgactgcaaactggccccccatgatcggcccttattgcagtccttcatcaaccactatgcaaatggtctgctggtaacgtcgaacacgtgcaagccgcggtcaattttggggggctttttaaaagctcaattctaccatgcaacgtaatcacgttacccaggtcactacattgacacactcgccactaagattgcattgcaaattagcggtaatgtaagcgctaatctgttacactatgtcttaattgggcatgttttatttactaaaaagtccgtcagtaagcaaattgcgcttaacgaaccgcttacatgatggtaaactttaaaggaagtctaatctagtttgggagtgaatcaattatatgaaaattaaacacctattattatcctcattagcaacaactggtgccattgcccttggtgcaactgctgctaaggccgatacggtgacggtcaaggctggtgacactgtcagtgaaatcgcagacacccacaaaacaactgttgccgccgttcaaaagttgaatcatttgaagaacgtcaacttaatctacgtcggggacaaactacaagttaacaaacaccagacagttaaaatgacacgggccaccatttcagtagccacgccaagtacgacgactacaacaactagtgccgccgttcagagtcctactagcactgttaccgccacgtcaacagttagtcaaagcacggcgagtcaagccagtgccagctcagttaccagtgcagccagtcaaagcagcacatcggccgttagccagagcagcacgagtcaaaccagtgccagctcagttaccagtgcaacgaaccaaagcacgacgtcggccgttagccaaagcagtactagtcaagctagtgctagttcagtcactagtgcagccagccaaagtacgtcaacgacgagtcaaagtcgtactagtcaagctagcgctagttcagtcactagtacgacgagccagagtgcaacgtcggccgctagccaaaacagtactagtcaagccagtgctagttcagtaaaaagtgcggctagtcaaagtacaacggtaaccagtcaaagcacgactactgctagctcagccgcaactagtagtgcaagtactagcagcacaactgccagtcaagctagctcaagcacggccagttcaacaacaagcacgacaaccagttcgactagtacatctgaggctgctgccaaggcctggattgctgctcgagaatctggtggctcctacaccgtaaccaacgggatttactatggtaaatatcaacttggtcaatccctcttaaatggcgattattctgccgccaaccaagaagcgaccgccgacgcatacgtcgctggccgttacggctcatggactgctgctaaagcgttctggcaagcaaatggctggtactaatcagcatctgcaattatcaaattcaagctttatcattgacatcaaagccagcgcggacgactcatcgttcgcactggcttttttcattaaaatatagcagtgctgttctgatttaatcaggtcgtcacaccaccaattctgttatactaacgctatcctaattgagacggagggctcacacatgcacttaacattgacccaaacaaccattaaccagcaaacttactggctgggcacaacgcccgccggcttagcctttgtcggccgtgccaacggtccacgcgacgaatggcaagccttcttcaaatccgctaatattcattatgatcaacaagctaatcaacaagcctgtcaagaattacatgattacctaactggtcaacgccagcattttgacatacccctcgaccaaacgacgggcacccctttacaacaccaagtttggcaagctttaacccgtattccatacggtcaaactgcaacttattcacaactcgccacaatgatcaatcaccctaccgcagtccgagctgtcgccagcgccgttggtaaaaatccactccttattgtgatcccctgccatcgtatccgccgcaaagacggtcaacttggcggctatcgtggtggtttgccaatgaaacgcgccctattagctcttgaaaacgcccgcttgcccaaataagcttcacttagaaccaagcgcacgcccttgtcacaccgaatcaactatgtcatcataaaatcaaacaatgattgctaattgtgccaatagttattaggcctaattaggattaaaacgtgccaagttgtgtaagttcaaaaacagccagcttaggcccgctggaaaaagttcgagttagtgtaaacttcctttgctggttcgtcctacaccgacttccaggcatttctgccaattgcnnnnnnnnnngctcaaatcgatgtcggcttacgttccagcaattggcacccaaccccccagccccggaggtcggcataggacgcacaccggctgacgaataacaatctaaacttggcacgttttaatcctatttcatgactaattagctcgcacaacacgtaatgactttatttcaagaatttggaggacaaactaatgctatccatcgcacatattcagaagcgtttcgggactgttcaagcattaaatgacgtgtcatttgacgtccatgacggggaaatcatgggattgattggtcaaaatggcgcggggaaatcaaccacgtttcacagtatcttaaattttctatcattcgacggtcaaattacttggaatgggcaatcgttgaccgctgatgactacgatcaaatcggctacttacccgaagaacgtagcctaatgtccaaattaaccatcacacaacaaatcgtgtacttagcccgtttgaaaaatcagccggcacgggtgaccaagggcaaaattgccgcatggatgaagcgctttgcggtcaaggggcagccgaccgataagattgataagttatctaaaggaagccaacaaaaggtccagctgatttgtactttaattcatgatcccaaactgattatcttggacgaaccattcagtggtttggacccggtcaacgccgacctgctcaagcaagctattttagatgctaagcaacggggcgccgcgattattttttccagtcatgatatgagtaatgtcgaagcgatctgtgactcactcgttatgctacgtaatggtgaagcagtccttaagggtaccgttgaagatgttcgcgcccagtttggccgtacccgtctcttcttgacgactgactggtcacaagcgcaactggccgatctaccaggagtcgccaccgttactcaacaaggtgcccgccgattccgactcgaacttgcagatgcttcagttggcccagcgatttttgatcaagtcactgctggtcattacattgaagagttcagtcagcagccaccaacgctggatgagattttccgaactgaagcgggaggtgttaaccatgaataagacttggattgtgacttttgaaacctacttgcggcagatcaagtcctggagctttttgtcactcgtctttatgcccttcttgttcttcgggttcgtggccgccttttcttattttgctgcacccagcgctagtaagaatgacatcgcggtcgttagcactagcccacaattacgcacaagtttcattaagcagagtcatgtggctaccgctaataaataccaaacactcgccagcgctaaggcggcaacgaagcgcaatgacatcgccggctacctcgttttaacaaccaagaatcaacagttgcaagcgcagttcactggtcctaatgctgtcagcagcggtgacaaggccaagattcagcagttcttagccactgcccaaagccaacgcaacgtacagcgcgcacaactaagtgccaagcagactcaggcgttggctgtacagcccaaatttactgaacaattacagaaacacgctgcttcagataaaacggctaaaacggtctccttctatattgtcgtcttctttgtctacttgattttgaccacttattcagcaatcacagcccaagaaattgccgcggacaaaggcaccaagattatggaagtcatcttctcaagtacgacaccgcggaaatacttcaatggtaaaatttacggtgtcttactagtcattgtgactcagctgctcgtctacttagtgggtggctttgccgtcatgcaatttgttaaacgtagctcactcacaattgatttttggcaacagaataccgatctgatcaatcaagtgattcacaatttggtctcaatcaacttgttgtttgcattactggccgtactactctacaccgtagcatcggccttctgtggtgctttggtgacccgggtcgcggatgctagcaaggcagcacaaccggtcatctatctgagtatgctagcgtttttcatggccctagcctttcagaacacacccaccaatctcttcgttaagattttctcatatattccgttcttctcatcatacttcatgccattgcgcctcattaacggcatggcaacgatgcccgctgcaatcgtgtcactcctgattctcattgcaacaatcattggaagtatgatctacatcggccgaatctatggtgggctaatgttacaaacggatgaactcggtttctggggcaacttaaagcgtggcttacggttgaagtaagcccactaattgaatattattaatacaatataacaacagcaagcacccggtctagcaacgccattatgcgctagaccgggtgcttgtattttttgaattcacattttcgacttatcggcaactagctcaaacaaccgttaacaacagctaaatcaagttaagcctgcttcgtcggataaatcgtaaattcattaacgttaacatcttctggttggtcaatggcaaagttaaccacgttcgcaacggctgctggactgattcccacttgttgataaaaatcagtcatattctgtttggccgtcttatccgtaatcgtgtgcaataattccgtattgatggctgctggatataagctgaccgttcgaatattggtaccttcttgggcactttccatccgaatgacttccatcaaattacgaaccgcaaacttcgtagcaccgtacacgccggagccagcaaaggacttaatcccagccactgacgatgtcgtaataatctgacccgatttttgagcggtaaagattggcatgaccgctgccaccccgttcaagacgcctttgatgttaatatcaatcatctggtcccattcatccgtgtgcaaggcactgattggcgatgtcggcataatcccagcattattgaaaatcacgtcaagcccaccgaattgcgtttgcgctagcttaaccagtgcttgtacatcggccgacttcgttacatccgtcacctgataggccgcttgtccaccggctgccttgatttcatcaactaaagcggccaggcgttcttcacgccgtgcgcccaatacgactttagcaccattactggctaattgcttagcggtcgtcgccccaattccggacgaggcccccgtaatcacaacgactttgtttttaactgtcatctaactattcctcctattcaccgtaaacttctttaatcagcgccagtgctgaccacgccttaggccaccccgcatagaaagccaagtgggtaacgatttcaacggcttcatcctttgagataccatgatccttgcccatcttaaaatgcgcctttaattgtggaaaatcaccactagtcattaagcatgcaatcgtaatcatgctccgatcatgtaaacttagtgcgctttcgcgtgaccagacttcaccaaataacacatcatcatttaacgcggcaaattgtggtgctaatttgcctaaattgtcgcgtcctgcggtttgtttaactgtcatattagttccctccttcaataactgctttaacttttataattttgcgtacgcttcatcgtcaactggttcgagccattcgctagttcccttagtaatcgcgatgtgggcaaaccaactatcctttgttgcaccatgccaatgcttcacaccaggatgaattgtgaccacgtcgccgggatgtaataactgggctggcttaccagcctcttgataccaaccttcaccactcgtcaccaataagatttggtatccgttatgatggatatgccaattattccgacagccgggttcaaacgtcacgttggaaacattcacgtcgacctgctcatcaccggctaaggcattcaggtaactttgaccgataaagtattgttggtaggcctcattctttacacctaatccaaataggccgctattattagttgttgtcatattaaaaacactccttaattatttgcttgctaactgattgatgaatacagcttacaacttaaagtacactttaagtcaacaataaagtttaaacttgctaaaataggatttcgtggtattgttattgctaaagttacttcaaataaaagttagaataaggagaattttaaaattggtaaggactactacagaacgttattcaatcggtgacttcgctaaagccgttggtctcagcgcccccacactacgctactacgaaaaagcgggcttgattgaaccacatcgcttagacaatggccggcgctattatgagactgccgatattaactgggtcaaattcttattacatcttaaaggaacgggtatgagtattagcgaattgcagcaatacgttacctggcgcgcagccggcgacgacacgattcccaagcgattagcactgctcaagcacgttaaagaagactttctcgtccagttcaacgaagtccagcatcatctacagattctcaacgacaaaattaattggtatgaagaaaaggaagctggtattacccaggatcacgaagatttttcgagttacttgcaacggtttgggcatcacgaataacctgaataacgcacaaccgtcaccacaatcattattaagttagatacaccgaggttcagtcgccttgctcaaaaaagtaatagtcatttcaagaatcaattcttgaaacgactattactttttttgaaaccttttccagcataatttaattcacgattattaacgtttccgttaagccagcaattccgtaatcattttttgataaatctcgatgaagcgcccatacatatccaaatcaacatattcattaacttggtgcgctgtaatattgccgggtccgaagacgatcacttgcatatcaggactctttacaatataagacgatgcgtccgtcccaccaggagcaccaaagtacgggagccgctgttgtaagacttgttccccaaccttcttcgccaactggaccaactggctatcttccggcgtatgcactgggtagaacgaacttgcgatgtccatcgttagattggcaccatccgcattgcattcagcaatgatggcttccaaatcattaatcaagcggtcattccgtaattctggaatcgtccgaatttttactgacatttcggcactggctgggacggtgttgacctgttcgccaccactaattaacgtcacgacaggtacggttgggcccaatacgggattaacgatagtcttgaaactgtcaaaataggcggtttgtttctgatagtaagtcatcaacatatcgatggcgttttgaccaatcgctggcatcgaactgtgggccgccaccccttgcgctttaatcgtataagtcagtgaacccttatgcgctaattcgatgaagtgttgttcggtcgtcggattcgcatccgccatccgttgcgccgtatcgtcgtcaacacctaacatggcttgaatcgacttggtcagtaaaagctgtttgtccgcaccgcttggttccgcacagatcaacgtttgaatatcatcggcgtaaccgagttccgtcaattgttcagcacctaaatggtcgacttcttctcccacagttgcgagtaaccgcaccgtgccatggagtgggacgtcttgatcgtgcaatgcaatcatcgcgaaaacttcagccattagtccagccttcatgtccgtcacaccgcgaccatacaaccgattatctttgatagttgctgccaacgggtccgtgtgccatttatctgcatcacccaacgccaccgtatcttcatgaccatccaacgcgacgactggaccgtgaccatcaccaatttcggccaccaagttcacccgcccgggagcgtactcgattgattgtgcttcaataccatgttgctttaaaagtgtgaccaaataatccgccaccaattgctcatggttatttaccgtattaatttttacaatatcgcttaatgcctgtacagcagcttctaactgtgccgtttctgccatgccattcatcccctagtcatccttaattaaactgttccaatcaatttaattataccacttcggctaccgttggccgttgtcagacacgtttaatcgacagatttcagtgcatccagcatattgactcgctttaacttacgatgcatcattcccatgactaataaactaaaggccagggtcaataatgccgcgtaaacgtaactcaacggatgaatcgttggtgaaaacattaacgcgttcgtttcagccgtttgcaagatatatgcgtgcaaccagttgcccaagaaacaaccggcaataatgcctaaaaccgtcaatatcagattttcacggaaaatatacatcgtcacttcaccatcgtaaaagcccaacactttgattgtcgacaattcccggatccgttcagaaacattaatattcgttaagttatagagcactactagcgctagtgcccccgccgagatgacaaagatcaatacgactaagttcatgctatccagcattttaaaattagtggctttctctgtactcatcagtgtcacgttctgaacccccgcctgtttcaatagccgatccgcataagcattttcttgctttttcgttgcctgcttaaaccggacatagttcgtgttatatactggtgcctgcttgaagacacgtcgataataagtcggactcatatagataaagtgattgacgtaattttcagccaccgcactgatgtgaatccgcttggtggtttgcccggccaacttgattgttaaatcatcgcccgcatgaacgccatataacttagctaatttttcatcgatgaccgcaccgcgattaccgatatgaatggcctgatgactttgtcggtgccgtaataccacgaacttgcttagcgattggtggggtgctgggataccgagcgtagccgtctgttctgctaccccggactgtttgaccgtcacctgcttggcctgtaatttcaaactagcctggtaaagttgaccacgactaagtgcttgccgttgttggtccgtttcgttcccactacgcgtcaccactgcatcgtagtgccacaattcgttaaattgcttgacgctaatatcaccaatggaatcctttaagccaaaccccgtaatcatcattgccatgcagcccgcaataccgagcacggtcatcagcaaccgttgcttataccgaaatagattacgaagtgtgattttatgattaaaactcagccgatgccatagccattgccagcgttctaatagcaaagtcttaccggccttaggtgctcgtggctgtaagagttgcgcgggtaaactgtttaaatccacgcggagcacgaccagtgccgtccccaacgtgcacaacaacgcaatggctaaggcgataccaatgtccatccaaatgtattgaaggttgattgcgggcaaattatacatactaccataggcctgcgcgataaaccgcgggaaaaaattgacgccgaacaggacacctagcgcggtcccaatcagcgcggctaaaccaccataaatcataaactcgctaccgaccgcggtattcgtatacccgagggcctttaacgtccccatctgtagccgcaattcttcaaccatccgcgtcatcgtcgttagacaaattaacgcggcaatcgcaataaagaacagcggaaagacagtcgacagtgccacgactcgttgcgtattttcgtgatattctgtgtaacccggattatccgtacggtcagtgtacaaataagtcggcattgtgatggccgcgacctgggcctgcgcgcgttttaattggctttgtaacttgactagttgtgccgttcccgctggcacttgactagcaagttgctgggtcgcctgccgcaatggtttcagcttagcctgggcctgggcttgtaatgcctgctgccgcttacgcgcttgtggttttaaccagcgtttgagttgcgcggtgttctcgcgattcaagcgccgatacttcgccgtgtagggggtgacgccccgcaaatttttgaattgcacgtcaatgcgcgttatcacactggacttaatcacctgcggacggacatagaccaagtagtccaaagtccctttaccaatgttggtgacaccacgattcgtattttcaacatacgttggtgaattgacaaaccccacgaccttgaatgttcgccgcgtgaactgtgcattgcgcttagccgtactgctaattcgatacgttgaaccgacttttagcttcggctgcaatcgctgtgcttgcgcgtctaacacgatctcattggcatgccgcggtaaccgtcccttaacgatccgtaaccgattcagtcgttgggttgtcggtaacgccatcacccgcacgacttgactattgttcaactgattaacatcagcgtagcgtgtcgcttggtaagtgagctgtgagcggtgttgattcagtactcgtgtatcggccttagtcagccccattgtcgactggacactattggtcgccagcttttgcttcgcataataatcattagctgcctgtgacatatccggaccggtcgcccgaattcccgtataaaaagcaacccctaagaaaatgatcagtaatattgaagcaaaacgggctttcgacgaccaaatctcacgcataattgttttaaaataagctgctgtcatcgctgcacctaccattcaatctcagccaaaggcgttggatgagcattatgctcaaccgactgcacttgagcatcattgatacgaatgacttggtcacccagctgcgcaatcgcactattatgcgtcacaatgatgaccgttgtctgcgtctgcttagccgcatcttgaatcacctgtaagacttgcttccccgtctgatagtcgagcgcgccagtgggttcatcacagagtaataatttgggattcttcgcaactgcccgcgcaattgcgacccgctgttgttcaccaccggacaactgggctggaaagttatctgcccggtgcgtcagtcctaccaaggccaacgtctcatcaacgtcgcgtgcgtccttggtgatttgcgacgccaactcgacgttttcacgcgccgtcaagttcggaaccaggttgtagaattgaaaaacgaacccgaccgcttgccgacgataggtcgttaattgccgtgagttaaattgcgcaatgtccacaccatccaccagcacacggccgctcgtagggctgtccatgccacctaaaatattgagtaacgtggacttacccgcaccactcggacctaaaatcacaacgaccgcaccctggtcaacttcaaatgaaatatcacgattagcaacggtgacctgctcaccatttttaaactggcgcgttgcctgctgcacttcgatgtatgccataatttagcctcctatatgtaatcggttactattatcataccgtattttcaagattcacggttagcatttaagccaccgcttgcattttgcctcgcattgcccgtacaatgacaacagtcactgacactgataattccagtgttatcacccgttatccgaggaggtccaactatgattgcccaagccattgcgactgttttaatgctaattgtttttatgttcggttttacttactttctgaatagcctatttttcagacgcatcgaaaaacacgaccgtgaacaaactaaaaaacgcgaacatcaagaccaccactcgtcttaatgctcgcgtcagtacgtattatgttaaaaataggactgccagttaagatcaagggcagccaacttcggcctgtcggaaaagaggttgtttagcgtaacctggctttgattacacgtctagcaagacttacaggcagttctaccaatggctaaaatatgctcgctgtcgccccacgctactagatcaacgcttcattttcctcattcaacttgtcacagtcaatgatcaattgacaaacttctttgtctggcgtcaacttcatcgaatacttccgcccatattcaatcatcgtgtgatgggcttgatgtaattctgccggtgccaacacactcacgattttttgttcaacttgtaacggcgtcgcggtctgagcgacaaagtgcaagcgtttcgagattgccgagacgtgtgtatcgacagcaaacgtcggttgttcaaaaacgtcactcaataccacgttggcagttttgcggcccgcacctggtaacgccatgatgcctttacgatcggtaggcacgacatcggctaattcttcatggacaatgcgcgccgttttaatgatgttgcgagccttattatgaaataatccgacgctcttgataattgcttccacatccgcaacatcggcagccatcaagtcctttggttctggatacttctcaaacagtaccggcgtcaccttgttaaccgagacgtcggtcgcctgagcgctcagaattactgaaatcaaatactgaaacggcgtccgcgagtccagggaaggtcccgctggtccgatgtctgcttccatttggtgaattgcccacacgatctgatcatcttttagcattgcgcttaccgcctctttcttatcctgtttctaagttaattttaaggctgagggggtgtaatgtctattattaaaaatatcgcggccttatttctaatccaaactttaatgacatgaacacagtacaattaatttctatcaatcatcatcacgatcagcaaaataggcggcccgttgccgagcccaatattcatggtcagcggtggtgatttctcgtaagacatggcaaggattgccgaccgcaaccacgttatccgggatatcatgagtaaccacggaaccagacccaatcacgacattactcccaatcgtgacacccggattaacgaccacgttgcccccaaaccaaacatcgtgtccaatcgtaattggccaaccatattcgagttgttcagcacgaatggcggcgtcaatggggtgacccgccgtatataagccgacccgcggccccataaagacgttgtccccaatcgtaatccgacccacatcaataaaaatcgcatcgtaattggcgtaaaagtgcttgccaattgtcgtgttgcttccatagtcggtatgaaatggcggttcgatatagcccccgtcaccaattttgttgaacattgccgttaacaatcgttgccgttcttctggttgggcttcggttgtttgattaaattcccgtactaaccgtttggcacgatgattttcacgtcctaattctggatcatcagcaacgtacaactcacccgccagcattcgttctttctgtgttttcatactcccagttcctcccatcaatcgcattttactttcaccagcatagcacgcaattatcaccatgaacacgcattctcgaaagcaaccgcccccattttgagtatcgttgaacttttaagcttttttatactgcgaaaaaatcattatcgtttataatgagaggtatacacacaattaagggagttttaaccattgaaaacatttaaaagcattatgagctgggtggtcccgattgcgattggcttgatcatcgccttactgattcgtcagttctggtttactatggtcaaagtcgatgggacttcgatgcaaccgaatttacaaaataacgaacgcgtcgtagcttttaagactagcaaaatcaaagcaggttctgtcgtcgtcttcaacgcctacggactcgatccgaaccaaaccgacaaaaacgccgtttatgttaagcgggtcattgggatgcctggggatacggtccgctacacaagttccggtaaactttacgtgaacaacaaattagtcaagcaaacctatctcaaaaataagtatcaacagacgactgggtccttcatggctaatagtcacagcaagttcactggttggacactcaatagtttgagccatgatcaaggctgggccaagtccgtgaccaacaatacggtgccgaagggttactactttgtccttggtgatcaccggagcgtttctaacgatggccgttactgggggctcgttcctaagagcaagatgattggggtcgtcaaagcatggccatggcagaaccgcaaacaatatattaataactaccaaccttaagatttgaacaccttatcagcaagtcgttaactgcgacttgcttttttattatacaaatgactcgtttgtatttacattgtcctcatttattgccgatgtaagatcattggcgtcattaggcagaatcggcaacaatacatcaatcattttcaaaactaacaaaaaaaacgaatcaacaaagttatgaacaacttgttgattcgtttttttcgttaaccagacttttatccacagttgataactcaatgtcgttatcaacagtatctgcataagtcttccactcatttgatcagtttcctgaacagattatcagtttcgactacttttggcgctgacgccaatcccggaccccaaaatacccacaaataatcgggcttaaaggaaccaaaatcactgccatcaaaatattcttaaagaagttgataaaaccatccatgaagtcactcttagcctcgacttgtggcgttaatgcggttggaacgggtttgggctttgtccgcttggctgctactgaccatggtcggccagagtcctgaatgatttgctcatcgtctggtcgcgttgacggtgtttccttgggttgtttacgccagacttgaaacacccgcggccaacgatacttcacaattggaaacagcacgagcgcacaaataatactgtaaatgacgaacggattaaattctaacacgatccgattgacttcctgacgggccgtaaaaaacatgataatgaagacggcgattgcaccgtaaaaccaactaattagtaaatgactcgttttccacacgttgtgccacctccccggttgttgacatactcaatcgcaccatacttttacactgcaagccagcttcatagatcgggtctggatagttatccacaaaaaagttgacccacaccgcaatcatctcaaaaccagcgtgttgataaatcgctagttgccgcaacgatgaattaccagtgccaatttgcagttcatcacaggttggcgctgcttggcagaccgcaatcgccgttgctagtagggccttagcaatgccgcgatgttgataggcgggcgccaccgcaatatttttaacttcccacacccctgttttgaacgttgtcaacacgacaacacccaccacttgtccattttgttgataaccataacattggcctgtcgataagtacgctgtgacctgtgcccaagatggatcggctaataacagtaaatcccgtggaatttgagctgccgctaggggttggattttcatgactgccgcctttgatgccgctgatagccgttaccccaacaaacataaggaatgatgaccgcaataattgctaaagcatactcgcgcaccgttaagttcatggcattgaccacgacaaggtacgccaaaaaaaccgtccataaaaccggaacgataccgccgacccaaaagtagcgactagccgtaaacaggtactcttctaagataaagataacaattgcaataacacctaaaatcagtaattgcatggggccacttcctaacttgtgattaacgcagtgcctactgcttgtttaactgttgtagcatatccacaaaacgtccgattgttaagttagccacatcttcatcggaatagaagatgatcatttgggaccgttgttctggggataagttcgcttgggagccaaaataaactaggtaaacgtccgcgctatggtccgtcaaactctgaccataatctgtatctaacgtgaagttgaaatctgcgcccaattgtttttccatggcggccatgaaagcttgcacatccgcagttgcgaccgtctcttggccggccaccgtactcgtaataacattaacttgcattttaaaagctcctcgttaaaatttttaaactcaattttcacagtagcgcacttttgtataaaccgcaagccgctagttgtccacagtggataacttattccgtgaccggtacaatcaacttatccccagtgtaaaccatcgttgtcaccacacttggtgccaatgcctgtctcgttgccgcacgaccagttgcgacgtaatgcatcattcgcaacgttgcgccgtccacaaccaacaagacctgaccatgatcaggcgttgccgtcataacctgttgtagccccttctgatagcgatcccagaactcctggccactttccgccaatccatccgcatcgtgatcgtgcaacaatgtctgtaactcactgggggtctgatccgcagcaaaagcggccacgctctgataacccaacttagtcgcaaaccctgaccaaaccgccgcgcgttcagttccttcaaaaccgccatagaatggcgcacgtaacgcgactaccgttcgtaacttaacgggttgtgctcgtgagtctaagataatgcgcgcagtctgaatcgcccgactcgtatcactagcgaaggcggtatcaaacgttgtcgacgccaactgctgcgcaaccttggccgtcgcctgctcgccagtcgccgtcaacggcgtgccgctccaaccctggaaccggtcaagttgattaaagtacgttgctccagcaacgactaagtgtaaggtgattgatttcatggttaattctccgttagtttttttagattattcaactattttagcataaaaacttggccggacaaacggactctaggacttgtttaatatgaatttgagtagaattgtaatcaagaatgaaacaactatcattttaaaacatatagctggcaaacaaaaaatcaggataagaatcagatgtgcatccttatcccgaccttaattattgtgcggcaacagctcgttcattttggctaaccgagaattagcgaaaatcgccatgctgaatactcatcaagtcaccacacgtcttttgatggtaagcttaacaccatcattgtgtatttctcttcattagtagcgttagatgtataatatcgaacattggtcttaatcaccataattgttatatgccacagtcatcagaaattaaaggtattatggttcgcttaatatattctattcaggaattgtcacaaagcacaggcgtgttgcctttagttgacagtctagccaagccaacaaatactattttcctaatgcgtccgttttactgaccactaatcactagtcgctttagtaggtactggctttctgcgcactaatgacccaatcaccattcttcttctcataaaacatctgcatctgcaaccgccaagtatgcgtacccccaccccaaattcttgcctgaacttggttctgaccaattaaacttgcccggttaccttcaatttgaatagctttgatggtatcttcttttgaagcaaaatattgcatttcttcattttgaatttggtcaatccactctaatttagactgcacataccccgtcatgtgggttaacttcatagttggtgccaaaatttcatttaaccgactgaggtttttctgaaccatagcaatattttcatcacgatacaatttaataattatttctttatccgtcattcttaccacgctttctttatttacatcaagcatgataccaacttttctatgccaaaaccattcagaaatcaagggtcattcataagtaaaaattatgcaaaggtttgtttcaataattcagcaaaagtttcgatataataacctgaattattagcttgccaataagcgtaatagttctgaatcaattttcggtcgcgcgttttataatcaagtnnnnnnnnnnaatttgttcttgcaatttgggatcaattttcggtcccctttaaccaaggaaatcattttaacaatatctttatctaattgtgttctcatccgctgattgatgatcaaatacccctgattagacgcgatcaacatttgtgcctcgtcatagcttttagcaatcacaaactcacttttgacacctaaaacattgcgatagtactccttttctgagacttgctgattgccatcaatgatcaaaatacaaggaatatccactaagtcagcaacgtcgattttttgtgcctcaactggcaacgaattgttaacggcaaccataaactcactagcggtcaaaaattcattttgatattcattggataaggcccgccgttgatcagaaaaattcaaatcaatttttcctgtctgtaataattcatagagttcttcgtgcgtgccactactaattttgattttcactttaggaaactcctgagtaaacttcgaaacagtttgtaaaaactcggcagtcccaaaacttcttaaatagccaacccgcaactcgacctcatcattcttttcaattttgatggttttctttataagttggtccacatccaccaaaatatcctgactatgactataaaagtattgacccgcttcagtaacttcaaagctgcgtcctttccgattcaataacttcacaccaagttgactttctagctccttcatttgctgagaaatcgctgactgcgaaatgtggcagtccacggccgcttgagtaaaactatgattattaacgattgcgataaaatactgcatctgttgaaacattaatggcacctcaacctttacaaaattatctttgaatgttcaaatttgtcatattattttaattagtataaccttaatcaacaatttgagaaatgttttgcagcagaacctgaaccgattccctaccatgcttataaacgaaaaaagccactagcaatctagccaatgaccttttgaatattattttgcatttagtccaacactatcatgtgcataataatcattatcgacaatcgcattcttgacaaaatccgcaattgaattgattgagacatcatgcccaccaaatggttcgccttttttcgtgatttcataatcaacaggaccaccagtaaaccagcccggacgaatcagggtgtagttcaaatcagaagcttcaacaacatcggcggcttcccgataagtgcgtagcattggattactacttaaatttccactagcaccaaccgaagcgggaatttcatcataaatacccattgaagtaataaacagcaatcgtgaaaccttattccggtccattgccgcaacaattttttgggcaaagcgacctaaagaaccactcaaggcaacaaaaacaacgtcttgtcctgcaatcgccttgtctaagtcactatctttagtaacatcgccagcgataacactttcacgctcactagtctttaatcgattggcacttctagcaaacaacgttaactgattatcggtttcattcaaaagcgtttgtcgaactacaccgccaatagtccccgttgcaccaataattaaaactttcttcatattttcctcctatttatcactgacaatgaccaatgacttaatcgccgtccgttggtccattgcttcgtacgcagcttgaatatcatctaacataaaccgtttcgtaaagacttggccgggctgaattttccccgtcaaaacagcatctaacaaaacttgcttgtcatccgtcgttacagcagcaatcccaccacgtaagccaatgttcttccaaaaaagattattggtattcatttcagccttttgtgggaccccaacgcgaccaacaaccgcaccaggacggccgactttgactgctgtgtcaacggattgttcagtacctacacattcaagtaccgcgtcagccccagtttcggtcaaagccatcactttggcaactgcttcatcaccacgttcagcgataatgtccgtggcgccaaatgcttttgctaacttttgccgatcttcatggcgactcattgcgatgatccgcttagcgccaagcaattttgcggaaagcaccccgctcaaaccaacggcaccatcacccatcacaacaacggtatcatcctttttgacttctgcgctagttgcggcgtggaaacccgttgccatcacgtcagctaaggctaaaaagttgttcagcatgtcgtcagaataatcttcgggttgcccaggaatcttaactaacgcccagtttgcattggtaaagcgtaagtattcaccttgatagccaccgttaccgccagcttcttggtttaagcaatccccatcaaaaccggctaagcaagcggcacagtgcccacaaccatgggtgaacggcgcaatcacgaaatcgcctgcttgtacatctttaacggctgaaccaacagattcaacaattccaattgcttcatgaccaacggttgaacctgcttggcgttgtgaaatcccgcggaaccaccacaaatccgacccacatacacaggcccggagcacccgaataattgcatcggttggcttttgaatagttggtttgtcgtattctttaacttcgacttttcctggttcaataaaagttgctgctttcataataaactctccttaaaattctatttctggacgccattgttacgaacttctgaaacattaccataccaatattgtgcggtaattccgccatcaaccaagaaatcactccctgtgataaaggcaccacggcgatccattaagagttccgccaaattggcaatttcatcgggtgttcctggacgcttcgtaaccattgactcgaacatctttttgtaacccgcaccacgcggcccgttcaattcgtcaacggctaatggtgtcatgataataccggggctgatcgtgttgatccgtgcactgcgagcttgccacttaaccgattcggcagcgacccgtaaaacattggttcgtttcgcatattgataagccgccaatgaatccttgatcacgtccggttgtaaaattggtaaatccaataattcttcagtcggtgtcatagccaaggcttgattatctgcttgtgataaggcgggtaatcggtgtcctgattgggacgaaatgacgattcccgcactaccgggagccatgacttgaccaaattcttctaacaaaacggcagtcccgtaaaggtccactttgagcacttgctctgggctcgcttgggatggtgaaacgccagccgcgttgaccaatcccataatcttaccaagcgattgtgccttagcaaccactgtcttaatagattcccgtgatgaaagatccgcttggatggtcttaacgttaaatccagcttccgtcaagtgttgtttcatttcaactaattttgcttcattatagtctgccaacaataaatttctaccggcagcaacacgtcgaacaattgcttcaccaattgagccggcaccgaaaagcacaattacttcgttattcatattcattgacctctttacttgttttgattcaccttaacttacaagtcatatcttacaagcaaacgtcttttagaccaatttcaaattcagcccacattgataagttttacttatgaaaagcaatatcaggaaatcggccaccgctagacctggttttctgatattaattgtatctctaattgttttttgtaaaaatcaaatgtaagccgccgtcctctttgtactgtcgccactaacgtgtggtgcaatgactattttttatccgttatacttaacctcctttactctttgttaaaacaatccctcaaaaagagtcgcttcaataaaaaaggattgcccagcgccctactgaacaatcctatttaacatcatcagaatactagtaccatcaaaaaactgatgcgctttaagtaactaacactataattgcctgtcactaaccattttaggagtcagctaactggtcccattcacggtctgcttgggagatactgtcacgaaaacccacccaatcatctggattagcaaaaagttccgaattgattggtgtcataatcagtgccggaccactttgctcaattctataacgtgcccctacttcaaggctcagttcattgggaaaaatgattccctgagcattgccaatcttacgaatactcacttccatctatcagcacacctttccatcacaacttaattttcagttaatcccaacgacatgtcacggtcactttaccacgaagtcatagaagctagcaaacatctgatttgctcaaatgaacactgctttgataacaacggtattcaagacacaaccactattattcatcatcaacaccatcgccggaaaatgatactcaagacacaacaaaaaaagccctccataaccggaaggcctgatcaatcaaaattcatcttatcactaccgaatcaccagtactgaaatcggtgcatgttttgccatatatgcggcttgcgaaccgaagtatttacgaacaccatgcttggcaactgagccaatgactagtaagtcaggcttcaacgctggaatcaccgtcttcacgatggtttcaccagggtcaccttcatcaacgaccgcgttaacatccgtcaccccgaagtcacgggccaacttctgatactgctggacgtgttcttccaaatccttgcgttggccatgaacaaaatctttgctcattgcttcatacacgttcatattatcctgttccaaaattgaaacgatggttaacttagcaccgtcactcttggcccggttaatggcataccgaaacgctaactgcgcgtcatccgaatcatcaacgccgactaagatgtgcttaaattccttaggactcatctctgacatatggctccactccccattctctgataatctgactacacccttattttcatcaatttgagcataattgtcaattatgactgcggtgcattttgtttcaagacacgcgccggattaccgactacaatgacgttatctggaaacgaatgcgttacgacagccccggcacccacaatcacgttattgcccaacgtcactccgggtaagatcacggcactaccaccaatccaaacatcattaccaatcgtaatcggtgcagtccgttccgcttcagtccgccgcacagttggatctaatggatgagcaggcgtgtacaagccaactttaggaccgaatttgcaatcattaccgatcgtaatgagtccttcatcacataacgtgaccccatggttcgcataaaaatgattgccgatacggatgttgacgccataactgaattcaaaggtcggttcaacgaagaaccggtcaccggctgaacgtaggaggcttttcatcttagtattccggtcatcattgtcagcaatctgattatattgcattaacttcgtccgcacgtctcgccgacgttgctgtaggattggtgattctaagtacaattcaccattaatcatttgttgatacgctgggtcattatcgatttccatgtttaacttccttttaagtatgatactttaagcataccacaccattcaaaattgctgtatgatggtttaaataaacctattgaaagtagtggttccatgcaatacgcaatttttgatctcgataataccatccttgactttgaccgcgctgaagcggctaacctcgcagccgtctttcagcatcatggcatcactgatattcgccgtgcagaaaatgagtatcaggcctataacgaaactgtttggcaacaaatcgaacaaggtgccgatcgtgatagcttgttagaccaacgatttcaagtctttctaggcacactgggcatcaccgttgacggtcctgcggttcaacaagaatacgaccaattattagcgcacagttatcaggtaattcccggcgcccacgaacttttgcgcacgctgaccaacgctgggctgaccttactcgtcggcactaacggtatcaaacacacccagctcagtcgcttggcaggtgcccatatgacgccctattttgatcatatcttcatctctgaaagtatcggttatgccaagccgaacccacactttttcagcgctattcatgaccaatacccagacatgaatgccacgaataccgtcatgattggtgatagcctgcgttcagacatcgcgggagcggccaccgcccatttacctagtatctggtacaatccacagcatgtgcataacgacacaacaattgccccaacttacactgtggataactttaagcaactgcaaaaactgttattaacagcttaaacgcaaaaataatcagcaaactctgcgcgcaggcctaacgtatcttaaaaactgaactatttaacatattaggtaacatattaggtattatgcggagtagttgtatcgacggcttttaactcaataatctgcttaccttgatttccaatcaacaaaaagaccatttgacgaatcagcaagaaaagtaattcatataaaacagttgtcgttgcttaattcaagatttggccgtgaaacaatactaatagcagttcatctgggtaatctgtcaaaacgtgccctttcttctcaggtgataagattttcagatttaatcgacttgacgcttgctatcaattaacgtgcgagaagaatagctaaaggaacgggattaaaaatgagttatattcaaatttttatgaaaagaagccgtcgcgccggtaatcaacacttaagctcaaaaaattacaagcaagggtacttttaatacctgatataatatcagcatccatctaatttttttaaagctcgtcaccgctagcgcctttttatcactgtctaaagtatcactgctttgtgcgccagcaatcaactgctgcatctcctttattggacccaaactatccacaaacgcaattacaaaagaaatgaaaccaacacacttcataatagaagaaaccaaaagcatgtactggtaatcagtatttagcacgagttcactaaagactaagaccggtatcgatgccagtaagaacagttgcattatcaatcgtattttttcccaccttgtcttatttctttttttgagtttaactaggcttaatttcaataagaaattttttttatgctgaattcttttatctataaaatgagttaccaaatagtacaagcaaccataagcgaaaagtatgataacttgtttgaatagcatcgatcgagaaatcagcatgagcagctcattcgaatatgaagacattaatttagaaagtcctttctgaagtcacctaagtatcttagcttagatagcagtatttaataaaaaacgttgtgtctagatttctcattgaaatgaagcacaacgcttttggtattagaaaataaatgattatacgcctgaagaataacactattatgattcatcaggtcagacaagggttattgcccatgcacctgctttgacagcggagattaaattcaggcgctgtaagtggaaaacctgcattattccaataaatttcgataatagttgaaagtatcattgcttgatctagtatatagatagctgggaactaagaacacccgtggctaaatataataatatgtattgtgcgtatagtcgaaattcattaacataatctgcaaagcctattgaatgggcacactgcatctcatacgatataaagcaggtaatgttcacacttttatttaaccaaaatagcgtaaagacataagaattttcacgttcctcttattgtgcctatcggatatttccgtagctaagtgggcggagttaattgactagactcgtatcaataccattgtcctcatcaaaccgtataaacaataattaacctcaattaaaaaaagccatgcagccccattcttacagttacgacacagtaagaatcaggcttcatgacccataatacgattcaaatttaaccacgcggcgacgattggcaggaacacctgtcaattgatactcaccgcacggcccaatcaaagtgacactagccacaccttttcttacaaggtcagcactagctattttggttcaaaagtgaacccctttttacaatccactattcttcaatctgaacaaagtgtgtgttacctagtccaccgccaacttgcatgacactgccgccatgccgaagcttgcccaagttaacggggcggaaattcaacggccggacgagcgcagcgaattctttcttagcagcaacgtcatcgcccgcatagaacaagacccgctttccaggcccatcaacgtgcccatccataaactccggtggaatcgtattgaaggctttaatgacccgggcattgttagctgcacgagcaatgacttcacttccagtcaacggggccgtcttaattttcttaaagtcagccgtaaactggttcgtcacgtccaccacgatccgttgcttataatcggcgacctgcgctaatactgccggcgcctgttcaaacggcactgcaagaatgactaacggctgttgtaaggcttcagcaacttctacaaaagccacattggcagcaaactcggcgcgccgtgttgctaaactagccgcaccactgtgccgacttaatttgatttgatgatcaccgcgcgcaaaggtcttggctaatactgtgccgaccgtaccggcaccaataattccaattttcataactatcctccacctcatcttttaataatggtttgaattaaccgacttatctggtccgttatcacggactgtcagcggtcatctagaccaaaccagcttatcttaatggtagcgaaatcattatggaattgcaccccatacgcgtcaactatgcttgaacttgttggtaagccgtaataccagcttttaatcgtgccaatccatccgtcagggtagtcgttggacaagccacattcagtcgcaagaagcggttgccatcaccacggtaaacatctcccgctgataaaaacaacccggttcgttggcgaataaaagcagccaaagccgcactgtcggttgtcacttgacgcacatccaaccataatagataagtcgcttgggcttccaccaacttgacttgcggcaactcagcagtcaagtaagtctgaacttgacgttgattggcagctagtttggttcgcaatgcggctacccagtcatggccttcagtataggccgcaatgctggctggaatcgcaaacgaattgggttcagccaattcatcattgttgatgccccggctcactaatgcgcggacgtgtgcatcgggaataatcaacgttgccgcgtgtaaggctgccacgttgaaagttttgcttggcgagatacagctgatactgttatgtgctactggcgcagtcaatgatgaaaatggggtgtacgtgtgaccgttaagggtcaagtcacaatgaatctcatcggcaacgactagcacatggtatttcaagcacagctcgccaaggcgttgcaacgtcgcacgtgaccagacgatgccgattggattctgcggattgcacaaaatcatcatcgtggtcaacggatcggctagtttcgtcgtcaaatcgtcccaatcaatcgcgtacgacgcgccacgtgccactaagtcactactcaaggtatgccggccattgttttcaattgaatgatagaagatattataaaccggagcctgaactaacacgttatcgccggtcgctgtcattttacgaacaattgatgaaatcgccggaacgacgccggtgcagaacatcaaccactcaatttgcggacggaagttgtgttccgttgcccaccagtctgccacggcttcatagtaagccgtggggacttcttcgtaaccgaagacgccaaactgggcgcgttttatcaacgcttgcttgataactggtgccgtttcaaagtccatgtcagcgacccacatcggcaattcattatccgcgacgtcccacttaacggcattcgtgtgccgccgattaagtacggtctcaaaatcaaacggcatggggcgcacggctttcatggtcaacactaatcagggtctgatgaggatctacttcaggatcatccatgatgatttcaccaatggcttgcgcatgaatccgaccactaagcggatttttaacgctatcaatcgttgaaaccacgtcagcgtcaatgttacgacaatattcaaaagctaagtccgtattgagtaacgtacagttttccaacttaacattatccatgtaacacaggccctgatcgctctcaatcgtacagttgacgaaccgaatattcttcgaattccagcccaggtattcaccaatgatttgtgaatcataaacggtaacattttcacaattccatagcgcatccttggtcatcagcgttgcatgatgaatttcaacgttcttagcaccgtcaaaggcgtaattaccgacgaggttgaagccatcaatgcgaatattctggctattcattccaaaataatcaccagctgcttgaacatcattcaacgtaatatcttggcagttccataacgtttcttccgcatctgaaaagtgaacgtgcgctaacttaacttggctggcccgccgaaatagcttaggtgcctgtagcgtactattcgtaatcgtaatatccttggtgtaccagatgccagagcgagacattgtctcaaacaaaccttgatccacagtcacatgttgactgtaccacaagggatatttccacttaaagattggctgtttcaacgtgacatcgcgactttccttcagtggtgattcaccatcagcaaacgttgtattgtcgatttcaaggtcgtgagctttaaagagtgcccgctcgcccgttaaatactgttgtgtgattgttttcaatttaatctcaataactcctttatactgaaacgtggacctttagtcgcacgataggatcagtgtattacttcaactgcacgttaagtcaactaacttgttcgcttactgtccggaatactgattccaattattagttcgtgaccggttaagtgccatcacgccctccaagtcatggggttggtaaggggtttccaagtactgtatttccgaagcagttaacgccaaccccgctgcctcagccactgcatctaaatgatgcggcttagttgccccaataatcggcgccgttactcgttgttgtagccaggccaaattaatggccgccattgaaacatgatgttggtgggccagttcctcaacgcgatcaataattggttgatccatctcgctggtagcttggtatttggtatcagcaaacgtatcctgttgtcgccgagtagtctgggtgccaaaaggatgtgccaaccggccactagctaatggactatacggcgtcgttgccaaatcgttctcatgagcataactgaacagttcccgttcatcctcgcgatagaccaaattataatgactctggatcgagacaaattgtggataaccataacgaaccgctagcgcattgatctgcgcaatctgccaggaataggcgttagaaatcccaatgtaacgaaccttaccggcctgaacagcttcattaagcccagccatgatttcagccattggtgttaaccagtcccagatatgataaatatataaatcaacatagtctgtctgtaaattctgtagactctggtcaagggaccgcaagacatgttcacgcccactgacatgattttcgatttcttgggttgtccgattcgtaaacttggttgccagtaccaattgatctcgctgaaatttctttagtccttgtcccaagacacgttcactcgcacccgcttgatagaccggcgccgtatcaaaaaagttaatccccagtgatatcgcgcgatcaagtacctggttcgcctgcgtttgaccaaccgcccacgagcgctgattaagcgccgttccagtccccgcaccaaaacccatgcacccaagtgcgatcgacgagacttttaaatcggatgttcctaattgtcgatattgcattgcatcacaactcccttcgttaactcattaccatctttattaaaacgcgatccgttggcagagtaaaatacctagttcaaataatcaattataaccattccgtatagttatccgtcatccagtcgttttaggaattaatgaccgttattagtcaccaatcattattttcaatgtgcctggcgacatccaagcgtggcaccgtactccaggtgttgggccaaaaatgaacagcacgattgcaagcataccaggccacatcctgcagtgagtgtcaccgaccgattttaaggacgaaccactgataaaccggttttgtgggcaccaccacaactcaccgcgaccacctccgccaactcaatttttcaacacaaaaccgaccattctagaagttacaccttttccagaacggtcggtcatgacaactgattgaatcgccgtaagcatcgctaccgacacgacgacaatgtttatttcagttttactttaatttttaactttttaggcgcttgatggcgcgctaagattaattgccagcccactttaaccagcgtactaataacagtcatcacgaccattaacgataattttcgacgcattcggcatcacctcaattaatttaaatcgagcataccacactttaatcgacgtgagcggaattttgcaactgaatcatatcatagtagtaaccatgctgttgcaatagctcatcgttggacccgcgttcaacgatttgcccctgatttaagaccaggatcaaatcagcattttgaatcgtggacaagcggtgggcaatcgcaatcgtcgtgcggttctcctgaatccgatccaaaccagtctgaatcatctcttcggtctcagtatcgacgttcgccgtggcttcgtccaagattaaaatcttagggtcagtcacaatcgtccgcgcaaatgaaatcaattgccgctgtcctgaagaataactggccccgcgctcaatgacgcgtgactgataattctcaggtaaatcgttgatgaagtcatcggcctttacaaaccgtgccgctgcttgaacttgttcatctgaaatctgatcgttaaacattcggatgttggaattaatatcaccataaaacataaacggttcttgcaagaccaaccccatcttctgtcgcaattcctcagccggatactcacgaatgtcgcgatcatcaattaaaacttctcctgactgaaactcataaaaccgcatcaaaacattaatcgtcgacgtttttccactccccgtctgaccaactagtgccaccgtttggcctggttcagccacgaatgaaacgtcttttaagaccggatgctggccgtcataggcaaaggtgacgtgccgaaattcaatcttaccgcgcgtaatcttagccgtaggatcggcgtgttgggccggggcaatcgttggatcatccatgacccgtaaaacccgtgatccggcgacgacgccatcttgaaagtctgacaaattatccatcatcgacgtcatcggattatagaagttattcaggtacgtgatgaacgcataaacgaccccggcagccacataaccattgagtccacgaaccccgaagattcccagaaccatgaccgtccctaacgcataaaacaagtcgatcagtggacttaataataatgagttcgtccggatcatcgcttggcgggtcttaaaataggcatcattggtatgatcaaattcaccattgatacggtgttcttgtcgaaattgctgaataacactaattccagtaattgcttcactcaacttggtattcaactcactgagccgttcccgcattcgccggtaaacccgtgagctataccgttgataataccaaatcgttacagccaaaaaaggcatgaaaaccaataaccacaaggcaatctgcgcatcggtgagatacatcgcgacaaacgacgaaatcaccgcaaaaaaggcggtaaatagtgtattaaacaacgcccaaaaattggaaaacgacatcgtatcgttagtcaggcgtgacaaaattgagccaccagggacttgatcaaagtagcgcatgcccatccgatgcaacttggcgaacatttgtcgacggacattttcaagcatatattctgcccccatcgtactactgaagttctgtacgaactgcatcaacgcgcgcacaaccatgccgaagaaatagaggcccgcaaagtaccacatgaccggtaccgtggcgtgtcctgttttgagataatgatcaataaaggtctgtaatacacgcggtagatagatattaaccacactaatcagaccggaaaaaacgatggccgcaataaaaaaccatttgaacggtttcgcatacggcaatagtcgccgaataaccgtgagttgttccttaacaggcatggaacgtgcccataccgattgacgtgctgccattattgcaccgctccttccactttggtctccaattgttggcgcgtaaacatcttctgataccacccgtgttgcgtcattaattgcgcgtgggtccctcgttcaacaacgtgaccggcatccaacacaatgatttcatcagcgttcatcaccgaacttaaccggtgggccgcgataatcgtcgttttgtctgctcgttctgcctttagattagctaaaatttctgcctcagtttcggcatcaaccgcggataacgcatcatctaagatcagcaattcaggattgatgagtaaggcccgcgcaatggctagtcgttggcgttgccctccagatagcgagataccttcctcaccaacttgggtatcgtaaccagcgggcatgctggcaatctgaccactcaaatcactcttggcggcgaccgcttccacaacggcttgactcacagtcggatcggcaaaacgaatattttcgcgaatcgtattcgagaacagaaaactatcttggggcacataaccaagggctggtaagtaactatcaagcgcatactgcttaatatcgtgaccaccataagtaatgtggccctcgtactgatcaaattcacgcaaaatcagtttcataatcgttgatttaccagcaccaacccgtccgacaattccgagcgtctgtcccgccttcaaagtaaagtccacgttactcagactggttcctgcatcgtcgggataattgaactgcttgatttgatactgaatatcaccatgcgagcgctgttcaatgccccgtttggcatcaataatggcactttgctgattcaataattccatgacccgatcatacgaggcgtttccccgttccatcgtgttgaataacatcccgaccgcaaacatcggccagaccatcattcccaaataagtgacgaacgagaccaagttaccgattgtgatgacaccgtgggtcacgtacaacccgcccaaaataattgtggcgccgtaagataacgcaataatcatggtaatcgcgggatcaaatagcgagtcgagtacgttgacatgccgattgatcttaatcgtctgatcaatctgttgattaaaatcagcaacatcggccttttcctgacctagcgctttgatcactttgattccactgatactctcctgcgccttattattcagtcgcgaaaaggcggcttgggaggcacgaaacgcgacgtgaatttttttacccaaataccgtgacacgaccgctaataatgggaaaggtaccaccgcaatcagcgtcagtcgccagtcgattagtgtcatcatcgcaatcagcgttgtcccaccagtaataatggaatccgcaaattggagaatgccaccaccagcgacccgttcaaccgccgtgagatcattggtcgcatgagccatcaagtccccggtacggtattgctgataaaacgtcgcatccatcttcataaaatgccaaaagagtcgttcccgcagcgttcgttcaaggccggctgcaccaccccagatggcattccgccataaataacgcgccaggtactgaccaacggcggccacaccaataataactaaatagaccgtcagcgtgtgcgccgtcaagctgtgctgattaatcccatcaacgatgtccccaataatccggggcggcacaatgccgataatggcagtcaaaactagtccaagcacccccgcgaggtacaacttccattcacgccgaaaataccagcctaatttcaaaaatatactcacagcgcacctccaataatttaattaaaatttaattagacaactttttataataccatacctcgcgcaaaccccttaatgataagttccatccctaatgcaaagtgattgcaccagattgaaaataagcttaaactggggacgttagtgggacggtcattacgatcgtccctttcaatcgtaaaaattcagattactgatttttaccaccgactattgggcttggtgagctgtccaaaatacgccaattatttttataaggagtgttgattgtgtcccaaccaagtaccgtcactttaaaaaccaaactggcaatcttatccgttggtttactctcatttgtcgggattctcgtggaaacatcgatgaatgtgacgttccccacgctgattaaaacaatgggggtttcactagataccgtccagtggctgacgaccggttacctattactgacaaccattgtcatgagtaccacggcctatgttctaaagcggtttaaccccaagcccttattcttatttgccgccctcgtgtgtctgcttgggggcattctttgttggttagcgccgaatttctccgtattattaactggccgccttttacaggccgtagccactgggatttcgattccactgatgttccagttgattttcacttacgtccctcgcaatcaactaggaacttataccggtttagctagtgtcatcgtgtctctagccccggctctcggaccaacttatggcgggattttaactagcgtctggtcatggcgggcaattttcgttggtatcgtaccgttattggcattactggcaatcttaggggcgttcaacatttcggggaaggccttaggtgttggcgataaaaaattcgactatctgggcgcaatccttttagccatcaccttcactagtctgttgttcacgtttaacaacgcgggaactcacggctggctgtcgccgaacttcggcctctggtgtctgtggagcatcgtgatgattggtgcaatggtgacgtacgccatcaaggggcgtcgccaactgattgattattcaattctcaaattgccaatcttgcgacttcggctatttaattactttggtttacaattcattaatatcgggttatcgttcgtcctgccacttttcgcccaaaccgtccttggggcttcggccatgacggcggggctcatgatgcttcccggcgcaatcgtcggcgccatcactgggccaatcgccggtcgaatttacgataaacaaggcccaacgaccttattaacatttagtgccatcatggcgagcgccgccttactattattctggctgacaaccgattatttcacagtcatcatcatggctgtcatttacgcgctactacgcgtcggctttaatactggttttgggactgcgatttcggatggtagcacccgcgtccctctgcctcaaaaatccgatcaaaactcgatgttcagtatgatgcaacaatacgccggttcaatcgggaccagtattatgtccgctgtaattgccggctatgaaattcatcattccaccgtaactggaacgattatggggagcaagttggatttcttgctattattcgtgttggcgatcgccattttggttagtgttttgcatgttaaacgacttgaagcagggcaaaactaggattgactggtagcaacgttagtcttgcaagtggattgattgctgcatttttagagattaattctttaatactttgaaactataccaaaaaggcccgggttagcgtacccgagcctttcttgtaccatataaaaaaccatttaccaactaacgcctaacttcactaataccaaccgcacaacattttcgttttggcagttacctttttaacacctgaacaactccgaatgcagcaatcgactattattttctagataggttattctagtcattcagcaaatcgtcaaacttaggcttagccactggcaagacattagcaccgattttaatactttcagataacaaccggaaaaagtcagctgtcataattgtttcatgacaaagtaactagcacaacgcgtattggataaatacataaagctgactgcatagtcggctttataccgttgcgggcaaattattacggttttagtgaacttgcataaaatagtttggaccaggtactggattgtcagcctcaaagtaaagaagaccatggaaggcggcgtggtaaggaccgccacttggagttgctgtaaaatactgtgccacagtgcttagatcaggacgatcagtaatgtaccctgtaaaagcaccctttttttctgaaaagctaacgttcttagcgtttccagttacaccacccatatatctgccatagcgtattcttgaaccagaaaatttatttacttggcaagattgccctttacccaatcgcttgacggctgttggttgtttcgggccccggtcttcgataactggttcttgagatgatgcatcaaatagcggaacctgattgccatctttgtcataaatcacgttttgttcagttgtaacgctttgctctgtaaaagtactcgagttggcatttacaacatggaaaaaaattgacacaatcagccctacagccgataacgatagtgcacgtaacacagttaaactaccccttttcataatacgttccccaatttttaccggtattatactttgtccttatatgatagcataggataatcatatgtcatctattttttcagatatttagctttaaaatattgatgaattttatccatcgacaccatttttatgtatgataaaaggacatattgcgccatgctgcaaccaagctgatcacaaccaattgaaagcatgtgtccaatatgtcccaagataattctactaaattactgatatgattattcaagaacgattacatatcgctcagatcaatatttctagcattggtgaatgaatcaccataacgtcaaagtgtattgaaagtggattgattgctgcatttttggagattaattatttaaatgctttaaatctacatcgaaaaggctcaggttttctttgacctgggcctttttgcgtactctagcgtcagtaaacacactattaagcagattactatctcaatgctttctaaaatagagtttccatattatgatgctataattgaaaactagtgacattacaaaataaataatggaaatacccaaaacattagcacagtattctgtaaaccaatatttgtattgtgtgagaagatcatatccaccatgtaaaacaaaaaaataaataactgatattccaaaaacaatcatgctttgtttgaaacttgatttaaaaacagccatcatatcctactcccatctattgaaaccggtttcgttttgtcttattatacatacgcaattcaaaaatgtacactaccggaataaggaggaagtccaatgaattataccagtcaagctaacattcacaaatttactttgatcattattttattgagcagtatcctaatatctactaccataactttgaaaatttctgccaatacgacgtcatcgtcacaacaagccatagattgtatcgctcaagaattagcagatgtatcaaatagcattcggtatgatccccagactggattagcaacaaacttagatgtgaacgctttagtatcaaaatacggttccaataaccagaaccaattgcagcatatcaacgagataatgaaatatgaatacaagcgaaatttgcaattcaaccaaggcaagctaaataagtattcaaactagaagtttttggtcctgtatgaaaaatcaattattggacatgattggctaccaaactttccaagcattattacgcggaggcattcaaggattaatccaaagaaaggcgtggaaggcagcggctaaattactaatcagataccttggagatagcatcggagtcgggtttatcgccgcacaattggcctggtacgcgattagatgtgcctagttattcattagttgcgctcactcgtagaaaaaagtaatgtcttcgaattatggtatcagtaaaattaaaatttaacccttttcgagaaaaaaaccgcgcccccaagacgcggtttttcgtcttggaagcgcgataatatgattaccagtaattacttaccagctttcatctgaatttcagcctcggctggaacttgcatatcgtgttgcttgaggaagaccatggaagcccacagtaatcccagcgacacaatcgtaattcctgctaagacaacgattgatgaccagaaaataccactaccccaaccaccagttaaggcttgccggaacgcttgaatcgagtacgttaatggcaagtatgggtgaataacgttgaagaacttgttggtaatttccatcgggaaggtcccaccagaaccaccaagttgtagcatcaagataaccattgcgacgaaccgtcctgggttatcgaatagcatcgataagaacatgactaggaacattgacgctaaggcaatcatgattgccgtcaagtagtattcaggtacactgattggtttcaaaccagcaactaataacactgtcgcttcgatgaccgccatcgcaagtgctacgggaccaccaacggcaactttactccagaaccattgtgttggcgtgccgtcgtcatccgcaatccgtcgaattggataagcgaagttgaagacgattgccccaacatacaaggccagtgacaagacgtaaggtgctaacgcatgaccatagtttggcacgtgcgtgtagtctttataggacgtcttagttggcgccgccatcattttcgcattcgcgttctttaatggtgtcgcgttaacttgatcagcaccttcttgtaaggaagtcgcgagtgtcttgttaccgttcttgatctgctttgtcccggataggagtttggcagagttgttgtcaagctgggtggccccgtcatttaattgactgacaccactcgttaattgaccggcaccggtgtcaagttgttggataccacttactaggactggtacttgaccgtttaacgttactaaaccatttgtgaccttacttgaaccggcaaagagttgttgaacaccactagccagaactggcacttgtccattaaggttaactaaaccagttgttaccttgccagagccaacttgcaactgttggacaccactgactaactcagggactttgccattcatagttaccaacccagtcgtaattttgttagaaccaactagtaattgactaactcccccttgtgctgtgttaataccattagtgagggtttgagaaccagtactcaatttatttataccggtaatcattgcgggaacactgccgttgactgtcttcaatccacccgtgaccgtttgggaaccactaaacaactgctcgacacctgaaaccaatgttggaattccaccattcagttgcgcagcaccagtcgccagttgtgtggtaccttggttcagatcatttgaattagcattcaattgctgactaccattactcaattggcctattgcgccagtaatttctggaaccgcgccattaagtgtggtgagtccagtactcaaattattagcacctttattaagcagagctgactgtgaagccaatttacttgtacctgttgataacgactcaatcccactaactaatccagggactttcatatttaattctgtcaatccattgcttaaaccatcagtcccactttgcagcttcttcagcccagtggttaattgttctgagccactggcaagttgactaattcctgaagtcgtggaactaatgtctgaaataatggtattcatcccagcttcaatctttccgtactcggttactaagtcagcattagaattacttgttgccgaggtgttctccgcaactaatgactctacctttgataggctgctctgcaaattttgaacttgttgcgcattagtagtagtcgtcgtgctttgtccaacatcttttagactttccttaattgccgcaacctgggtatcagttaaattctgtgacgactttaaaccatctattttactattgatttgtgacgtaatatcagcttgcgttggcgacttggaagtacttaaagcatccacgttacttgataaggattttaacgcggtatttaaagcatcgttattattactactcttcgtgttagcagcaatttctttttgactagctgccaatgcctgttcaaattgtgccatttctgtcttcaaagtttcgatttttgtcttagtcgctgaatcatttactgcggctgacaattgatccagtccatcagaaattttcgcactatttgtttgtaaatcgctaacaccggcattgactgtttgcgcaccggttgttaaatcgttaacagaactgctcaaattagtagtatttgatttcaataggctggcaccatcattggcggtaccaacacccgctgtataatctgcaactccgctagccaattctgttgagccatcagaaagttgcgaaacactactagacaattttccagtttgaccatctaatttagttaaaccagtcgtcagctgataaacaccatcagtatatgtggcaactccgactttgaccttttgggatccatctgctaactgtcccgttgcattactgattgtcccggttttgtcattcaaattctttagtccagtcgtgaccttgcctgaaccatctgtcaacaaattaacagcaccagctaatgtcccggctttatttcctaatgttaacaatccttcggtaatcgactgcgatccaatctgcattgtcggtaattttgagtcaagttgttgtagaccattagaaacttgagctgagccgtttgtcaattgactgacaccactcaccattgggacgacttttccttgcaacgtagtcagcccagttgtgacttgactggaaccatctttcaactgactgacgccactagccaacgcaccagtcttaccattcaacgttccaagcccactagtaacctgcccggaaccatctgataactgactaacaccactggctaacgccccggtcttactattcaacgtatccagaccggtcttcaacgcactaccaccatcagcaagcttagcaatcccagcaggtaattgctgcactttcgtattcagctcagtcgtcccgttcttcaacgtatgaacacccgtcgtatacgtcgtcaagccatcctgcagttcaacaccaccatctttaagcttggtggccccatcggcggctttttgatagcccttaccggcagtccgaatctgcttgaagattgctaatgcgtaggccttagtgacttgcgcccgaatactcttattaactcgtgaaacaccagtatcggtaatgactttagcaatataattcaacgattcgttggtctcataatgcaagttcatctttttcggattggtatccgtcatcgttgtagcattttttgagaaattgctaggaatcgtgacgaccgtgtaatatttccggtctttcaatccctgcttggcttttttagccgacacaaagtgccaatctaaatcgttatttttctttaaattcgtcacgacttgcttaccaactgcaaacttttcgccttgatagttcactgacttatcttcattaacgacagccactggtaagttttgcgtatccccgtatggatcccacaccgacttcaagaagaagatgctgtataaaaacgggatcaaaatcatgactgaaactgaaatccatagtattttgctatgacgaattgaccgccattcgtcgcgtatcattttcacaacctgaaaccttccttcaaataattaaactgtgtgttgctcaagtgaaaacaccgtcgcaagcgtcccctgaatcatcgcctgcgtgctggtcgcctgaccatcacgatgaccgttattgagccactggacaatacttgtgacgaccccactgactaagtacgccgtcaaatcgggatgctgcgactggcgaatcatcgcaaaaacccgatcatccgcacccgtctcggcgaccgtgacaaaacagtcattgatcacttgttgagaacgggtattgtcaccctcattgttcgtcactaataaatgtcgtaaaacttgcgtgtgcgccccgataaacgtcgacataattgccgaaccaaccgtatcagttcgctcagcagccaatagttcatctaacgtgtgcatcaccatctgcctgagcaaatcaaatttatccgtataataacgataaaaactactgcgatgtataaatgcttgcttacagatctgctcaaccgtaatttgtgagattgaacgttgctccaacaattggtacatcgcccgctgtaaatccagctccgtacgaattgaaattaccatcaccccgtttttaaattcttatattcgaatagaagaatatagttgccataaaaacaccgctgcatccccgtgcaacgattgctggtgttcatgcagtttagtgcaagtacggtttcaattccaagtccgccttaagcgtgtgaatcaaatgctcaacttgcgttagtggcgcgtcaaacgtcacccgataatagttacgggtcccctgatgttcaactgcgacaaagtgtcgttcctttaacgtcttcaattgatgcgaaacggccggttgcgaaatatgcatccgttcagttaattcaccaacagtcatgccctgcgcgtgttgcgaaagttcaatcatgatttgttgacgccgttcatcggctaagacttcaaagatcggaattgtttctcgaaattcttgcagtgcttcttcactactgaccatgcgattagcctcctatattcttatattctaatgttcgaatgtatcaatgataaagcttttttaatccgtttgcaacacctaaatccactttgtcgataaacgcgacaaattattatttttgtcgcatttgacgcaaaaaaaaagacgcctgaccacgcagtcagacgtctccaagggtaattagtactagcaatcaaaacgattgatagcaacgtccggttgggagccggagccgttgtatggaaaatcataggtgtttgggaaggccccatgatctaagacatcgcgttacttgttaataatgacagaaacatcagcaaattaacggcggttaagtaactcgaataactacagtataatcgctcagtgaaactttgctagtcctactttgaaccttttgtcgtaaaacaggacatttagattaaattgttgtatgaaacaacgacgtttaacagccgaccgtgcccattatgctgacctagatgactgtcttgccgcttaattcaacgccttcttcacatatttgtaaccatacttaaccaactcgcgctcgacttgcttactagtggtcgtcgattgagacgagcgactcgtacttgtattctgactactgctgactttatcagccccagcaacctgcatcgccgagtccgctttcccacgaccagtagcatagtcgaagctaacgccaggctcaacgttccaaatatagacgttgaaattgacactgccatcggttgagactgcttgcgaccagtaaccacgaggcatcaattcattgccacggaaaaccgtcgtcacacgataaatgacttttttaccttgttctaacgccgtacgcacctgatcttcataaatctgcatcgttttttgattcgagtaggccgtctgagttgccaagtttttcgggttatctaagctaccatcttcaccagcgcgatactgcccattagacgtcaagttaaaggataacgtgtaagcaatcaagtgcccgcgattttgcggatagacccgcttaccattaacggtaatcggttgattatgccagccagttgggctccacgtttgcgccgtccgtccttcagaccgtcctaaattggccttgctcaagtaagccgtgtccgtggttgtccgattcaatgaatctaaattaccgtaatcaatcttagaatttttccactgactcgctgccagcgtactcttaccgctattaactttgatggccgcagcactgcccgattgataagtcatttttgccagttgtttgtaagtttgttgcgtattaccagtcatactggtcgtttgattacgactggattcagactgctgactagtcgtcgaactcgtcgtatccgtaccagacgttaacaagctacaaccacccaacagtaagctcaaactcaagagacccgctatgccaacgcgtcgcattaatttcaccatgattctctttcaccccgtcttttttaagtacggttctatcataccgtactttcacaaggggaacaaacgttttcttttaatctttttgtacttgccagtcattccttataatcccatacttgaccgagtcataatactgcccttgccaataacgaacttgtggaatccgagcctcctgctttaatcccacggcttccgctaaccgcatcatccgcgtattccccgaccacgttgtcaatccaatgtgcggcaaagtcgtctcctcttggaataagtgggtcaaccatttagtcaacgcggtgcgcccaatatgctcaccccaatgctcctgattatagataatgatgcctacctctaaccagcgtttgagggaaccatccacaaagtgccaattaacactgccgacaatcacaccatcccgtgtgatgacccagttacgcggtcgaatcaaccaatcacgggggccaataattgtctcaaagtctgtttgagtcggtagttggtcatgaaaatacggtccattccagcgcatccactccgcatttggatcactaaaacctagttgccatagcgtcgttaattctgcgcgctgaagcggtcgaattgtaattgttgccgtcatttgatcacgccctctcaattcataggtctactatatcgaaaaaccaccctaacaacaatcacattcgtggacatataaacttacattaaacggccccttttccagcgaaccgaagctggccgtccttgactttagctcacttagggacaacgacagctaaaaaaccaccattctggctgaaagaatggtggtcataagtcttaagcgtgtgttgcaagctgtcgcaacaattttagtatagctgctgaaacgcgtttcaggtcaagcactaagttggcgccaggttgctttggtcagtaagtaccgcatgacgtggatcacttcacctttatcactggtaaacgtgtgcagttctccagccgcttgcatgcccatcttagccatcactcggccagaattagggttggcactcgcatagtgagcctcgatggtctcatagttcagcgtttcaaacccataatgcatcaaacaattgccggcttccgcaacataaccgtgcccccacgcagctgggcttaaagcgtacgtcaattcaccagtcgcaccactaccatgaaactcataaaacccaatcagttgatgatcacggcgacgttcaatgccaaaaacagtggtcgtgtctgccaaaaagtgcgtcgtaaacagttgctcgaacgcggccggactctgaacccgtcggtaacgtaaataagcgacaacctgcggatcaaaaatcatgtccgctaacgcatcatgatccgccgctgtcattggtcgtaatatcaaccgttccgtttcaaactgagtcaaattgccatctccaaattattattgattcgttaattataataatctactggcaaatgtaaattatttcgttccactctcaatgatttggcaaagtcacctgtgccagcatcgcagttcctaccgcttcaaatcgggcgcagttctaaatccaattctcgcaaattttaaccacaataaaagggccggtaaccaaccgtccctttctctgatcgacttgcaaaccccaagcttgccattgtgtatgtgcctcgtcatggacccagcccatcccgagaggtataaatgcttgtcaaacgttatgattcagctaactgagctacttatcactatcaataattgcttattaacaatgtcctgacaaagtaaatcgatccggctcccaacctaaatccgctgacaaagcgtatgtattgcttcataactttgtctttagtatagcgagccagcattgcgtttagataacacgaagattacaaaaatgttacaactggtctaaaccaactaaaagttagcttggtattgcttaatcgtctctggctacggacacccagtttatctttaacgaacaaagtcgcccactatggtcttaacagtcggcctttattgaactgaaagccgttgattgacatgtgcttgaataacttgtcgccgagaaccggtcaagaaataaatcgttatgccaacaaaaataatgacggtagcaccgattgtttgccattcgaacgcatccggcttaaccattgtctggctacctgatgccatcatgctcaaaatatcaatagcagcatggatcaccatcggcagcaagatactacctgagtacaggtacgtcgaggctaaaaaccagcctagtgtcgctgcaaaaatgatttgctcaaccgtggctgacaagggttggcccgcaaaaacgtttgtaatatgccacattccaaatagcccaccgcttagccacactgctaagtcgagttggtgacgccgatgccgaaaagcttgtaataacaaggttaaaacggcaaaacgatacaaccattcctctgcgattcccggttctaacccactcaaaaacattttccaagtcgctgaccgtagctggaagtcccaatgtgtgaacgttgtcgcccatgaaccacccgcactaaaggcattccatagactaaaagccgttcccaccacgatcagcccaaccactaaactagtttgggcctgacgattaaaccgccacgatgggcccgtcaatccccatccccgcagtaagaccccaacagcaatcacaaagcccagggcgcctaaaataccagtatcactgaccatctcgaatactgatggtgcttgcagattcggtaaaatcagaaaagtctgctgcgcactgacgacgccactaaaaatagccgtaattaggaccgcaatccggccaatcacagattcgatcggtttagtgaccaccactgccaccggcacgaatgcgaccattaaataagccatccccacagcaatcaatccctgctcgtctaaccatgacagctgacttaaccaagccacgaggttcgccagtaaaatcggcaagagtgtgaactgcagtactgtttggacataataattaacatgtcgcaaacgccaccactgtgcttgatcctcctcggcagctggccaccatgctagcagtccccatatcagcaattgcataccaccaactgggaaaaacacaccaccatcaaacgtaaatagttgaataaaggccgcgccaaataacacgatgagctgccccatgtaccagcgtcgtaataattgttcggtttctggcgtcataaaaaatcccccaatctgatatgcattaatcataccagattgggggacgctcacacgtgattttgtttagatttatcggattccacgactaactaataaagatcttgcacccggccctgtgttgcttcatgggccaagtattcatcataagtcgtatcaccacgatcaacaacgcctttcgcactcacttcgacaatgtggtcggcaatcgtttgaataaattcatggtcatgagaagtaaagacgatggcgcctttaaaatcaatcagactatcattcagtgcggtaatggattccaggtccaaatggttggtcggatcatctaataataagacgttagcccgactaagcatcatctttgataacattccccgtactttttcaccaccagatagcacgttcactggtcgttcaacatcgctaccagagaacaacattttacccaggaaacctcgcaagaaagtattgtcactttcttctttcgatgcaaactgacgtaaccaatcaataattggcaattcactacccgcgtattcttcattaatatctttaggcaaataagtccgcgaagtcgtttgtccccaggtcaccgtgccactatctggtgccatcgacccagcaataatttgcatcagcgttgtcgttgccaaatcgttgcggctaatcaacgccgttttttcattgggacggagcgtgaagctaatgttatcaagaatcttaacgccttcaatcgacttggagacattctcgaccttcacaaggtcattaccgatttcacggtctggcgtgaacttaatgaacggatatttacgtgatgatggtttgatatcatccaacgtaattttctccaattgtttcttccgtgaggtggcttgcttagatttcgaagcattggcactgaatcgcgccacgaattcttgcaactctttaatttggtcagctttcttggcattggcattcgcttgcaacttggccgctaactggctagattccatccaaaaatcataattcccaacaaatagtgtgatcttgccaaagtcgacatcacacatgtgggtacaaacttgatttagaaaatgccggtcatgagaaacgacaatgactgtcttttcgtaaccagccaaaaagtcttccaaccagctaattgattggacgtccaacccgttcgtcggttcatccagtaatagcacgtcggggcttccaaacagcgcttgacctaataagactttcaccttttgcggttcagttaactcgctcatcttcaagtgttgcatcgattcatcgataccaaggttttgtaacaactggtccgcttccgactccgcgttccagccatccatttcggcaaattcgccttctaattcagcggcccgaatcccatcttcatcgctaaaatcaggcttggcatacaacgcatctttttcagtcatgatttcgtataacttttcgtgaccacgaataacagttgctaacacttcttcatcttcgaaagcaaagtgattttgattcaagctagacatccgctcgttaggccccatcgagaccgtcccagcagtcggttgtaatttaccttccaagatttttaagaacgtcgacttaccagcaccattggcaccaataacgccgtagcagtttcccggcgtgaattttaaattgacatcttcataaagcttacgtgttgaaaactgcatactaacattatttacggtgagcattccattacctcttcttttttaaagtgaaattgtccgatagaaaagaggtcggaattaaacaaaccttccagacctctgtgtcgttaattatataactttaattttagcatgctttcagctcgtttggcaatcaaaaccatacgtgattttctgaaagtatcttatcattttcataaacaaactaaattaaccccacccgtaaacaccagttttaaccgtgtctagtgaacaggcttgcgcgaccaaagccccgcctgacgatcatcacgcacaccaagtaacccaagttagcaaaatactggtctcacaaaagttaactcaaaatatgttgttcaatataatccaatacaccatcgtccacattggtacctgtcaccgctgtcgcattggcttggacattttcaggcgcgttttgcattgcaaccgcatgggtcgcatagtgaaacatctcaagatcattggtgccgtcgccaaaaactaacatctcatccggcagaatacccaactgttcaccaagctgtttgagggcgcggcctttgtgcattcccggctgaatcaagtccatactgccctgaccacctgaagcgggtacggcaatgccagcgagcttaggggtaagttcatatactaactgctccgtcattgccgcgggacaaataacgtcgaacttcacaaccggatcagtaactgtggttaaatccgcacatgtctctaattggtaatagtagtcacgcatattagctacaaactgcgggttcgcgtgcgccaacacatggaccgtttgggtgccacacaatgccacttgtaattcaggatacggtgccagggccgctaacacttgctgagttgcttggggactgaacgtcgcagctttgagtcccgcttctcgttgccacagttccgcgccgttaccaccaatcaaccacatttcagggtaagcactaaaggtcgtggctagttccgccgcttggtgaccactggcaatcacaaactgaataccgcgctgctgtagcgccgcatagtcgttggcaaaccgctcctggtcataatcaccatgatcatttaaaaacgtcccatccatatccgttgctattaatttaatcgtcattactaatcatccatttcatgtaagccttttctaccccttagcctaccgattatgcccgcaaagtacaagtcttttctgatactttgttagaaggcaccaccaccggagccaccaccaaagccaccagaactaccgccggagaagccgcctgaaccacccgacgccgaactagcgcttccagaggcatctaaggcgccactaaaactatcgttgattgcaccggacaaatcgaagtctagcccaccattcgcatagaagagtgggtaatacacgagcatccccgtagccaatgcttccgtaccaaaatcaatcgccaattgcttagtcacttgattggctagtccaaaagccgcggcgtatggcaagatttgttcccacaaaatcaaatcaccgacttgggccgtattaaagtgcccaatatccttaagcatgcggcgtagtccattgatttgattacgtaattccaagcctgcgtcagtattgatggcaatccgccgcctttgaattatccagccgatccagaaagccaccgcggccactaccgctggaatcaccatcagggtcacgaccttcggactaactaataacccagcacccgtggcaatcatccccataacactcacgacaactgctgccatcagccattgattacgaagccgataattagtttcgtcttgatagaccgccacgtcttggtctacttcggtctgccagcggctaaaccatttgcccaaccgaccagctttatcacgcttcccatattttttgagatccgttaacatgaactgcccgtcaaccgcgattttatcaaaacagtgagccaaaaatgagttagtcactggtttcaattgcgttaaccgcacatccggttttcggtgacccgcaaccgtttcaatcgttatttcgtgattagctgctgctcgcaaaatctcagccgttaaggcatccgtattcggcgaccgctgtgcccacaatgactcagcaactgctggtgttactggtggcacgtcaaatgaatgattgatgggaatcggctgctgatgtggcttagccggatgacgagccagccaccaaagatagccaatcatgaccaataaccaaccagccaccgcggcaccaaagataacgcgacgcagtaactgattacgtcgccgtttttcattagcttcctgtgccaacttagcttcttgtttttggaccgtcgcttttcgcttggcagtattcgtccgcgtattcgtcgccgtgaccgtggttggaaatagtaggtgactttcaacgaattggttcgcgggattatgtcccaacgtcatcgtcacccggcctgccgcgcgctcaactttcgtctgaccactcaacggtccgtgcgtccaggcttgtaacgcgctcacattcttggcaggtaactgaatcacgattttgacattattcagtggtacatcccagccactaccaatcactttccaattcagttcggccgtgtctgcatagttcgttacgacccctgtaagccgataccgatagacaacccgtaacttatcatcttcttgaacttgccggtagagcttgacacgcatccggtcagcattttgggtcaactgatacgtgttgttggcccccgtttcacttggcgccgccgtcaccgtggtcccaccattcagttgcgtcgtgaccccttccaactgggccccctgaatacctttcaaatcttgaacattaaataccccgtgataatcatcatcaaattgataagtcatcgcttgcgttacattcgcactaccatcacgttgaatgactacattgacttgatattggtcaatatcataatccgcagccgcgcgcattgctaagctaaaccaccaacaaaatcctgccaatagtccgagcacgctcagccaacttaatcgtcgcttcttcgacatctcaccatcgccccctccaataatcgttagccctagtttatcatactcccccggtcgtggggcgcgagatactgccaccgttttcttaggcaaagccgtccttttgttgtagcatataaagtgacacgaaaggggttttagtcatgccacaaaccacgttaccgactcacattcaagtgcgaggcgcacacgtcaataatttaaaaaatatcgatatcgacattccactcaacgaatttgttgcgattactggtcgcagtgggtccggtaagtcatcactcgcaatgggcgtcctgtacgctgagggggcccgccgctacttaaacgccctgtcaacctttacccgccgccgaatcaatcaggtcggcaaagccagtgttgattcagtacaatacttaccatctgcattagcgctacgccaacgcccccaggttcccggcgtccgttcaaccgtcggcaccatgtctgaaagcttaaatatcttaaggctagccttctcacgactcagctcagcagtttgccccaatggtcaccgcatgccaccaacgctcgatgtggctgaaaatgatggttacgtcacctgtccgacttgtggcgccaaattcagagcgcccggcgccgaagatttcgccttcaattcaggtggggcctgtccgacttgcggtggcctaggccaagttcgccaaattgacccggcactcattattgctgatgaaaatcaaactatcgaagaaggggccgttgcttcttggcacctgcctggacgtaactttatgccgatcgttgcacgcgaaattggaattcccatcgatattccgtataaagaccttagtgaagccgataaaacacgcgtattgcatggtcctaagcaaaccgttgccatcaacattccaagcgctaaaggtaaaatctttcacatggacaacgctgtctacgagaacgcctttgccgccgttgaagatagtatggcgacgaccaaaaatgaacgggcaattactcggctgaatcgcttttacaagtttgatacttgtccagattgtcacggatcacgcttcaatcctcagttgtttaactacgaattaaatggtcaaaacattgcgacggttagtgatatgactgtcgccgccttgcatgattttgcggccacgattgtcccgtggctacctactaagatgcatcatcttggacaatcccttgttgatgaattgctactcagcctgcaacccatggaagaacttggactcgactacctcacactcagtcgccccggcgcgaccctgtcaactggtgaattacaacgcattcagctcggacgcactttgcgtagcgccacgactggcgtgttatatgtccttgatgaaccttccgttggacttcatccagctaacgtggcgggcctaatcaaagctttccgcgggctagtcgcccaaggaaattccgtcgtggtggttgaccacgacactagtattatcagtgcagctgatgatgttattgagattggtccgggggctggtaagcacggcggtaccgttgtcggacaaggcactgtcgcagccatcaagcaggacaaagagtccttaattgcgccatttctcaccggtactgccacgctgcgtgaacgccccgtattaaccgacgatgcgctctggaaaaagggggcccttgctattgaagtggctcatcactttaacatccaagacattacggcgcgcattcccaaaaaccgtttcacgaccgtcacgggtatgagcggcgctggtaaaacgactctggtactagatagtttgattccagcactgattgccacagctaaaaagcgaccactcccaacccacgttaaggcctttgacaatggtcacattcgacacgttgttaccgtcgactcagtgcccgttggtaagaatgtacggtcaacggtcgccacttataccaacattctcgaccatctacgccaattattcgccgccaccccagcagcacaagcaaacggttggaccgctagccaattttcatataacgtcgctgcgggtgcttgcccaacttgtggtggtacgggccaaatctccttagatgtgcaatacctgccagacatcaccgaagtctgcccccaatgccacggcaagcgctacaataaacagacgctgaccgtcaaatggcatggctattcgattgcggatattttagatctcgcggttgacgaggccctaccaattttcaaagcgcaatccgccatcgctaatacactccagattctgcatgatatgggactaggctacttactattaggtgaaagtacgccggcactctcgggtggcgaagctcagcgcctgaagctcacctcccgcattggcaaacgccaaacgggaacgctctttgtcttcgatgagccttcagtcggtttgcacccgctcgacattcagcaactcgtcaaagtctttgaccaactgattcagcaaggggcaaccgtcattgccatcgaacacgatctcgacgtaatcgccaacgctgattacgttatcgatatgggacccgcgggcggtatcaacggtggtaacattgtcgccaccggtaccccattagccgttagtcaaaatccaactagtgtaacagggcaatatttgaagacgcatttggccctattccacgtttaaccaatgaactgatgaccgacctcattcatcacaacggtcttatcgaatatttaatcaaaaagcgtgtctaacccccagctagtcaacttgctaggggttagacacgcttttgttatgctgagatagtgccaatgaagcggacgaaactaacgtccttttccttaatgtaccatttcagttagtcagccgtcccaagatgtctttttgagcactgcatttcactaaatccattcgtaagtcatcacaaagctgatagccacatcctaacgccaaattgaaatatcaataacaaaagattaacaattaatcactgccggtgcgccatcactgcccagataaacgccagcgcactcacaccaatcatcaccgaacacgccgccgtcgcaccaactaagttatataataaaacgatgccgacgctaccaacgggtgccgccaacgtcacaatcgaactgatggtaccaaagaccgtccctgttaagtgcgtgtcaatttgtggcatcatgatggcgaacatcttcgagtccagtttgccactcatgaagcccactgcaaacatgcccccaagaatcaagattagttgtggaacgactagtaaagtcacataggtcagcatcggcgctagaatcgctgccagtaacaattgaaacaacgagagccgatcaaaccaagtatttttagtaatgccacccaatacgctcccggtaacaaagaccacgttgaccattaaaattgcgaccgaatagctcacgggcatgcgggacgccaagtcaataaacattaagttcaaaatcgcatcaatactcatcgttgcgacgtttaaaatcatcagaatacccagataactgactgcgcccattctagtcgtcgtcagcatcactcgctgaatcacaggccaggcctcaatatgtcgtggtcgtccagcaactttgggagtcgactgaatcgctgaacgtccggccaacaagcagctagcggctccaataaaagtcatcgcattcactattccagctaacgtataatcgtgccactgggcgataatcaagacccctagtgtttgacccagtggctcaacaagcgtacttacgctcgcattaagccccatcatttgttggcgatcgtcaggcccaatccggtcttgaatagcaatcgtcaaaatactgccaccatatcgtcctagtagatccgaaataaagttaatcgcaacgaccacgtagaaaacaaccactgtttgcttagtaatcacttgggccaggacaagatataaccctgcttgaacgaccttagtgccaatcagccagttagtttttcggcgcgtctgatcagcgagtcgccccgttaatcccccgaaaacgtacggcacaactgtcaccaccgaaacgatggcaacaaaccaatgtggatttggaaaattctttgcgtacgtgagtaaaatgatattgaacaaactcacccccagcgtcgtaaaaaaatttgcactagcaatcgtttggagggtccgattttttaataaagtcagcattaacccatctcccattaagataatggacttagcttactcgtcattaccgtggtacaatcagcaagtaggttgcatatatgccacattaaggagtgctagatgacaaacatcggagaaactattcatcagattcgattaagtaagggcttaactcaacaagaagtgtatagcggtattatctcgcgctcattcgcctcacgctttgagagtggtgccaacgatattggcgccagtaaactctttgcaattctggataacttagcaatttcagccgacgagttacgattcatacaccaaaactaccagccatcagcatatgaccaggccctttggacaattcgtcacgcttatgaaacgctaaattttctcgccctagccacttggattcgcgaacatcgacacagcccccacgcctacgaacaactcatcgccagttatgccagcatcttgatgctatcctatgaccatcgttcagtcggcgtgacaaccacgacccagcccgcttttgatcacctgcgccaagccaagacttggaccctgcaggaactaaaattagtgcccgttctaattccaattattgcatccatcgacggtttggccgcactaacaccactgacaacccgtatggccgccaattgtgccagttatcaaacggcttggggcgatccctttcacgtcagcaacgacttactcgatttttatggatcactatttcaaactaaattgaactttcatgattttcaatccgctcaaaatctgaaaaccaagttcactgccatcgacagtcaccagttaaactgggatgggcggttgagccaacaattctggcttggcatctggaatctctactttggcgactggcaaattggcaaccaattgcttgatgaagtcagcgtcttagaaacacatcatcacccccggattgataatacgttatttgcaattcgtaccgttcgcactaagcaagcccagacttatcgccaatcgcatcagtctcacaaacatctttaacaccgaaagcctgttctagcctggcaatagattatgccagactggaacagactttttcttaatcacacatactgattaactgacccaaggcttgctgatagctatgcctttcagattgttataattagcgcgtattgtgttggcttgtcatttattttgtattacagcggaatacggaaatgaatttatagctcatgatagtctgagcttgagcaacgtaaaaagaacttctccaaattagaagaagttctttttacatgatattaaacaaaccctggcttaaaccgacttggtctggttcaaatgcggtagagccaagaaaatcactaatccaacaacaaataaaatacttaaagaagcagcaccaatcgttgacttccccgtcatttgggtcacgattccaactaggacggggcccatcacggctgagaacttaccgagaatattgtaaaagccgaaaaactcactcccactagtcttaggaatcaaacgaccgaagtacgaacgactgagcgcttgaatcccaccctgactggttccaactagtatggctaaaatccaaaaatccgtcgtactattcaaccgcaacgcgtacaagcagatacctaaataaataacaatgccaagcaagatgcccgtccgggtcgacgttttattcgctaaccacccgtaaagcagtgaaaacggaaacgcgactagctgaacaaccagcaagacaatcatcaacgtggtcgtcgtaattcccatatccatcccaatcgaagttgccattgtaaagatcgtgtcgactccatcaatgtagaagaagtacgccaccaagaaccacgccgcagcgcgataattccgaatgtgtttcaaagtcgaccatacccgttgaaaacttgaacgcaccggatgcgcactgggtgctaacgcgtacttttggtgaacgtttttcaacaaaggaatgtaaaagataatccaccacgcagcggctaagacaaaactccaccgtgcgaccccatagcttgataattgaccaaaaccactggttaattgtaagaccaagaataggataaacgccaagacaccaccgagatagccaaacccataaccatatgacgacaatcgatccatctgatcgtttggtgccacgtcagtcagaaaactgtcataaaacagattaccaccggaataaccgataattgataaaatataaatacctaatagccacttccaggcactagtcggggcaacactcagccctagcgtcatcaccattccgagtatcgaaaagatgttgagcattcgttttttggcatggggatagtctgctagtgcacctaggacgggcgccaaaatcgaaactagtaaggtcccaatactattggcataaccccagtaagccgttgcattggccggtgtcacaccgctactttgggcaactgccttaaagtaaacaggtagcaccgccgttgtgacaataatgccatagcccgagttggcccaatcgtaaaagatccaaccccactgctgtttattaaatttcattaagttacttcgcgggaacctctgatcgcaatcggaggcggaacgagcattaaccacaatattagtggtgctgatgtccgcccgcttttcctctctctcttttttgtctagtctttgaaaataccatcgaggcaatgtcccggcatggggccatcgaaactcaatccgagtaaccgcgcaaatgtcggcgcttcatcgactaagttagctgcttcaatcgtcccaccagctttaactgctggtccattgaataacagggtcgtttgataatcaggcttcgtcgggtcatatccatgaaccccgtggtaacggtctggttggccgagtgtcgctggatggacgggttcaaccacagttggccgtcgactttcatcagtaaaataataaccttcctgggcttcaaccatcaacgcacaagcggggtccgcaccacgacgtgcagccgcctctccagtaatgatggtctcaacaccttcaacctgactaaccaatgccttcaattcatccaattggtcaaattccggtcgcgtataaatgtacgttgagccgtccgccgtcttcgccatcacggaccagtcatcttcaaacgtctgatcttgacgtgcggtcaaccagccctgctgagcgaataacgtatttaaatgaatcatgtgatccacattaatttgatagtgatcacctaaaataacaaagttggtatccgcaaacgtgcccgcagctttagtcgcgtcaatcaactggcccacgtgccggtctagccggtgtaaagctgccatggcctcactggatcgcacaccatagcgatggcgcatactatccatgtcgactaagtgaatcatcgttaggttcggcttcttattcgttaacgtatcgactgcacaagccgtgatgaattcatctagttggggctgcttaatcccattacgaagatgcccatacttatgattcatcgcgagtaagaagagcggtgaactcgccttcaacgagacgagaacttggttcgtccaaatgcggttaggaaagatctcggcaaggttatatataatcttgctgccagccgtcactggccataaaaaagccgccgttgttagcttcttttgccgtgccaaatcatatagtgttggtacttgaacgtccttttgataccaataccaatctggtgaacggcgtgtcggttgtaacttagtattattaacgattccatgcacgctgggatactgtcccgtaataatcgtggtatgtgacggatatgtcagtgttggataaatgcccgtcaccgacttgacccaagtaccaccagtcattaatccactcagaacgggtaattctgcttggtgttcgcgtaaatcacgaaatcctaacgcatctaaggaaataatgaccaagtgttgatttgttgccatctcaatcgctccttcttacttaataagcttattcgtattattataccgcagaaaattaattggtgtcaggatcgttgacaaaaaacgggcgatcagtgaagcacgactgatcgcccagatttattttcaataattaccagctaacaatccctgttcttgtaaccaccgcaatgctaattgtgaccatattgcagcctggtcattcaaatacttgtccttgccaggtttttgcgtcacatgattggctaacgctaacccatgaatcccactaccaaataaatgatacgcagttgcgacctgatgttgtagcatggcctgcacatattttaacgaattgattggcgggaccaactcatccgtcgccgtttgccagacaaaagcgggtttactagctggtgtgactaggcgctgggctgcccacaaccgggcatccgtggtaatctgattacgcgccgccgaagtcgtgggaaaccccgctgtcaaatcaatgactggatagcctaaaataatggcagcatgctggccttgataatgatccaaatgataccgtgtgcgcaattctggttgggtcgcaacaccattataagtcgcaaccacgtggccgccagccgaaaacccggcaagaataatccgctgacaatcaacatggtgcgcggacgcctgggtcgtaatccaatcaattgttgcacctaattgctgcaacgcccaaggatagacgaactgatctcccacaattaattggtaattcaagaccaccgtatgcattccggcggccatcatccgggttgcaattggcgcttcttcccgcccagaatgataagtaaagccacctcccgggcagataatcatgattggataatcaacagctgtttcaaaatcactaatttggtctaaccaatacgccgtgatctgaaatgggtgtgccgcagtatttaatgtgcgctgttcaacttgcatatgttccccctcctactcccgtattaccgacttgatttcgctttcattatagaaggtcacatgattgcttgtcaatttttattcgaataaatatcgatatttattcgcttatttactcgctaatgactattatttgctataattaaattaattatatgatgagcgggggtattaaaatggggaaacaaacattcagcgacatctatcacgttttaaaggaccgcattctcgcgggacactacagcgttaagatgcgattacccattgaagacgaattaattacagaatttgatagcagtcgctatgctgttcgtaaggcaatcgcacaactagccaaagacggcctagtttacagcgttaaggggcgcggggtggtcttattggagcacacgccacaaacccagcaattcaatctggctttaaataatctcaacggtctgcagagcctcaacgcggagcgccacctcgattatcagaccgaggtcgtggcctttcagcaacgaatcgttgaccagccgcttagcacacataccgcttttgaagtgggtattccagtgtatgctattcaacgggttcggatcgtagacggtattcgggcagtgctggacattaactattttaacgcccagcgcactcccactctgactaagaccatcgcccaacactcaatttatcaacacttcaaaaaaaatggtctgaaaattgctgtcgttaaaagaatgctacgagtcgaatccgccaccgaactcgacaaagctcagctagcgctcggtgataataattgcgtcggtaatatgattagcatcgcatttaacgatgaaggacgccaggttgaatacactgaatcccactttattccgaacgaatttaacttcaatgaattaattcgtaattaaaccttaccaacattacttagctgaatggtcatccggaccatccagctttttattatggttacttactttagaccaattcagtcggtgaattaaatttatctgtgaataagtttcaacataaattaaaaatatattcgaataaaagttgactaatgtgctgaattatttataataaatatcataaatgctaatgggggttagcatttataccacgtttcactagtggcgcatttggggtcaagagattaggtcggtcatggagtagagagaattgagcgtcactagaccaatttggtttagtgacttttttatgcaaaaaaactgttgattcgcaagattaaacttgccgaatcaacagttgcttcaaaatacaattttaagcttaataccgacgcttccgccggctaaccgctgcagcacctaatactaatgtacttgctaatgcgattcccgctaaactaatcatctgacttggcgcttcatcagtccgtggtaatgcttgccccttagccactgccaatgcgctagccaccttagttcgtagagcttgtaattgcgctactaacgccgtattatgatgcgctttagcttgtgcgattgcccggtcaatcaagttgatcagtgtttcctcatacttaatctgatcgccaaccactgtttctttttgaacttcctcaaacgccgtttccaattcagtcgcagtttcgtccgtgacccagtcagctgtaatttcattgtcgacttcttcttcgatttgatcgacaacttcgtctggcgtcacaccagcttcgatttcatcttcaatatcgtcttcaaattcttcttctgcgtcttcagcttcttcttcgtcctcaatctcgtcaaagtcaggcatttcaacatcgatgcttggatgaactggtttgtcgtactctggttcttcttcttcgccattatctggcatttcgatatcaatacttgggtgtaccggtttgtcgtattctggttcttcttcttcgccatcgtctggcatctcgatatcgatacttggatgtaccggtttgtcgtattctggttcttccccatcgccatcatctggcatttcaatgtcgatacttggatgtaccggtttgtcgtattctggctcttcgccctcgccgccatccggtaattcggcatcaatacctggatgtactggtttctcatagtccggaactggttctggatcattttcattatcaacattatcctgtaaatcccaacgatgggtctccgccttcacgttgactttattagcaatgatgttgccatcaatattttgatttgcatcaatttccgccgctggggctaaaatactgccttggaatggccggtcgacactaatgacaccagttgctaacttgtcactcgcggttgaatcatagaagttccaaagcaaatggttatcaccaaagtcttcagtttctttattattccgctccgtaccgtcatcataaatgattttgatctgcgagttaacttgatagttggtcgcacctgccgtatcaacattaataatgaccgtattaccatccgcatctgccgatagtcccttgattgtcagcggcgtactcgtgtttaaaacatccgctgacagattgatcacaatgtgtccatccgcatcaggttgcatatccgtcacatcgatgacccgctgattcatatcttcaaaactgtcactcgtataggtgacgttcgcggacgcttcgctaagactagcgctcaattgttccaacttagcaaactctttgtcaaaatcaatatagacgttaccatctttgtcttgataaacttcagaggcaagtaaatggtcgatatagaccccgttgaccatcggccgattaggattcgaaatatcaatctcaatattttcgccaaagatgactttattgctccgcgtctcaccagccgaaacaaacgaactcccagcaatattactgatattttgaatatacgaaatatctttatctaataattcttcaataatgttcgtcccaaagttaacgttgcccactaagttttgcaccgcaacgttcccattcgtatgggcatgtagttccgcttcccgtgcaaaaatatggaattgggacgaaaccccgagcatgttatgtagatccggataatcgtccgtcacattaccaccatcggcaacggcatcgtttgcatgggtcacagcttgactaagcgccaccgcggcggtctggggcgttgcagttgtcgtcgactggtctttagttgtcgtcgtttgctgggctacactatcactagtcgtcgtaccggcaatcttagaactagcatcggtagttttagtagccgttgccgcggtatcatggctggtagttgagtcagtagtcgcacctttattagaactggttgttgtccgcgcagccgttgcagtggcagaatcagttatggtcgacgtctcttttgtcgactctgaaccggttgtcgcattcgtctcttttgccgtctttgaaccagctgtcgtatctgaaccagtttcagtattggcactagttgtctcatccaaattggtggtagcgtttgtatcagtatccgttgccgccttagtaccagccactgtgccagcagcagtctttgaattcgaaccatcggtatctaaaaccggctgattttggttagtcacatccgcttcagttgtggccgcagtcttcaaagtttgtgtcttagccgtgactgatttggttgtgcttgaactagttgatgccgtatcagtccccgttgcagtcgttccatcatcagcccgagccaccagcgttgttgtgcccatcgtcaagataacggcacatgcaaacgcccagcgacggccaattttgtacattttaaaattcgtccgttttcgctccatcatttacccacctaaaatatagtttattaactttcctttaattcaattctattttcacgctttttcatacaacattcaactctttatataatttattttgtattgttatataaacagtggatgactgtcaatagacgtgccagcaaccattacaggtcttaactaatcataagttagtatttttgttatctattcgtttacttggaatatcgattatcatcacgcacttattttacacaatgtctcaaacccacaaacagccgcctaaaattggtcaatacttgcctcgcagtacgaaaaattttggtgtgaaagctcgtttaagcaatcacaacagccgcatatccacacaaaaaaagactggtcacaatcaaccagtcttcaataatttaattagtcacgtattgaccaacgacggtcagtcccgttaacactttacgtccatgtggtgatttggtgtcgatgactgcggttaattcttgccccgcaagattaccatgatgcttaccgccagcccatgctgcaacccccgttacatcataaacgacaccatcaaccgccacgtatgcgggttgaccatcctgaccattatattttgctaattcagtttgattaaatgtcgctgaattcatgccgaatcactccttcacaatttaccgtcatgataaactggactgccaagtaaaagcaagtgatccgttcttaaaccaaataattgacctatcttgaacataacgcgacatcaaacgatcgccgaagtagttatacccccacaaccatctcggtaataccggcctaacctttgaccaacgaaacttaattgactaggtaaccatacttacgttagcacccaattaatcgtacccgtgatagcagttgtgcttataagtctgccaaaacttaatcgctgaccaattactgctacccacaactacttaatcttaataccttataacatcagcgacgccgtacctcctagtacggcgaccttgtgaaccagtactgttcatgtgtccagtactgcccctaactgcgttattaaaacgcacacctcagccactactgcccattcaatgggctgcgtcgaagcgtgacgtctagacacaccccgtatctaggacgtcgattgcttattgtcaaacaattaattaccttggggtggcccgatcgttgcgacccgatgattaccagccatactggtcgtaatacctgagataacagttcccatcggatcgacttgattacttgctgccagcaaccgttctcgaacacgaacaaccgcatgtctaatcgtcaataccaccgtcgttttaactggttggagccgttgtgtcagtagtgaaatcacttcaaccaacatctgcccagcaactacccagtcacccggtttaacgttgaacttaaatgtaggcgattccaaagcactggttaattgtccaattcgtagccagcccaccagaccattggccgctcgaaagccaattaaccgttgattggctgccacggctgtgataaccccagcaaagggcgcaacaatttgatctgttgccggtataatttgctgcttaaatcctagtaacccatataagtgaaccgtatttgcaagggtcgtcacattgatcacttggcgtttaaccggcgcaactacgggaattaatgagctaatgaccactggcacacttctcacttccttactttataaattggcaaccattcgtatttaaataaccttaacaaacgtaacgtaaaaaacttgttttctttaatatgtaagtcaattagtttaagtcattgactgttatctttacaacataaaccataccataattaaactagaatgccagcataattaacggtttcgattaaggtttacatctgttagcgttaattcgtaaactcaattaacgaacgatgctactaaatagctgaaattggccaccataaccccaatgtcgcactcaagcaatcttgtagatttgacatcatgtttccccaatacgtcaatcaggcaatgacggttaggcctacaatttcagtcagaccgattgcgagcaaaaaagagcttccggcttttattccgggagctcaacaagtcaacgttatttatttttaatctcagccactattcaaccgtaacacgcatccgcccgtgccgctttgaaaaatagaggttctgatcaacacggttgtacaaatcaatcggactaccatcggcttgatgcagtgtcgagacaccaaccgaaatcgacacattgatttcctcgtcttcatacttaacaacgagatgattgactgcttcaaagacctgacggacaatcactttggtactagccagatcataaccgggaaacaggacattgaattcttcaccaccggtgcgatacagcttgaccttctcgtcattggcggccaagaccgttgtgaccgtggcggcaacttcttgcaaaacgcggtcccctgcaaggtgcccgtacgtgtcattaacgtgcttaaagtgatcaatatcgaacatcatcatcgataagttgagattgttcttggcactatcatcgaataaatatttgatatgttccgtgtaagcggcaaagttctcagtctcagtcaaagcgtcgtgactcgcaaactgggccaaccgtaatttaatctcactatcttgggtcagcatattaacgtaggcgtacaataatcctgcaaaaatcattaagtagccatattcggtagattgcaaatttaatcnnnnnnnnnntaattttacaatctaccattcttgtaaagtattgtcccaatccagcgaatatttaagcttgatcaggccccacaagattccgccgtaaaaagcgaccgcgccatagtaatatagccaaggataccgatgcttaggtacccacagccgtagataattcatgctccagaaaaatagcacgaacacgacggcgtaactccacgattcccagtaaaaaatcgactggtcgaaaaccatgtacactatgaccacaggtaacaatgaataatacggcattcgaatattcaaaaaaaacgagcagaacacgacggcaatcaagtgaaagttaacaaactcccaactatctgctttaccgacgaccgacagttgcatgacaaacacaaagaccaacatgtaaatcacaccgtgccaagcattgacggtatcatcgtcaatgttaatgtgacgggcatgaaaccacgtcgtaatccaattaaagaggacccagtaaagtgttagaacacctaatataaagaaaatactcgttacgaacggcgaaattcgccaattagaccatgtcatcgtaaggatcctttctcagcatccgccgttgaccaattgccgaccatcatcgactaaccgcggtttcccataatagtaaccctggtgccattcaataccttgttgttcggccatcttttgatcaccctggtcttcgacaccttccagaataaattccagatggtaagactgagcaatatcacgccaaaatgctaattcatgaggaatgcgctccgcttgcccactcatccgtaagttttgcatcgcaaacttgatttgatcaacaaacggtagtgcgtggcgaatattctcaaacgtgttcgtgcccgtccccacgtcatcaatgcttaatttaatatcatgttggtggaaaaagagactatatttttgaatctcgtttaatgaaggacattctgtcaactcaatcgtcagcgcggccggattcaaccttttttttaggtaaatgatcgtccctaacatcaggtcgtcctcagcttgttgccggtttaaattaagggctaacacctgattagtcgctttcgtctgcaattgactagcaagttgttctaataattcagcttgtttatctaatgataattcagtgaacgacttcggaacggcccagtgaccattcatctctttacgtaacagtaattcataaccaaaaacagctcgatggctgtgatcaacttggggttgaacaaaaaaacgatacattcatgaagcctcgcttttaatgatttctttatgtcaatataaattgacaactcctgtaaagtataaccgcttttaactaaaatatcgagacatagttacagactttaattaaaaaaattattaagggttatatgtaaccgttatattgaccgtaacaaaaaagaacgtcgtgacgacctcgtcataacgctctttttaccagtcttaatttcacttaaccaacttatcccagatgacgactttaccagctgttagcgacttaggaacgtcgataatacgttgattggaactcccccgaaattgtagcgagagatccatcttatcttgtaaaaagcgcccatctaccaagatatcaattaatgatagcatcttcagtttatcctcagagtcttgttgcaattcttcccaagtataacctgaccacgaccaaatatccttcgtgttttcaaattcggagcgaatgcgttcacaaatccgaatgccgacttgagtatttagaaacggttcaccacctagcaacgtcaacccttgcacataatcttgcccaaggtcttcaataatctgatcttccaattcttgtgaatacggttgtccataatgaaaattttgtgccgccacattataacagcctggacagtggaatgggcagccgctcaagtacaagctacagcggaccccttccccatcaacaaagttaaatgccttataatcagcaacatattgttcacttaagtcctctgccagccattctttgggcatcggattgtttggtcctttcgtagcgcgcggcattcttaatcatctccggagacatatttttagcacgggacgcgatttcaacgtggcgaccatgtaccattggtcgttgttgtgggttacctagatacccacacgtccgcttaacaacatcacagtatttagggtcgtgattgccacattctggacagacgaacccacgggcagtggccttgaactcacccttaaacccacacttaaaacactggtcgatcgacgtattcgttcccaaatagccgacatgatcataggcccagtcccagacggcctccaaggctttaggattctgagtcaaattaggatattcacaataatgaataaagccgcctgacgcatattgtggaaaacgttcctccaaagttaatttatcgaagggcgtcgggtgcttacggacatcataatgaaaactattcgtgtaatattccttatccgtaatatctgcgatccggccaaacttcgcaatatcgtcacgacagaacgtatccgtcaacgattcagccggcgttgaatacagactataatgatagccactttcagccgcccactgcgcacacttatcccgtaacgctttcaccacggtctccgcaaaagctaacgcgtgctcgtcttgttcccagttcggaccaaagaaggtcgtgcagacttcataaattccaatgtatcccagtgaaatagtcgcccgctgatttttgaagagctcatcgacattaccacctgctggtagccgcttaccaaacgccccatacatgtataagagtggtgcattttccggcttagcttccttcgttcgttcgatacgatacgcgagtgcttcatgacaagtcgccatccgttcctcgaagatttcccagaacaactgttggtctccatgtgcggctaacgcgattcgtggcaggttgactgtcaccacgcccaaattcatccggcccgagtttacctcgacaccattttcatcacgccaaccttgtaagaaggaccggcaccccatcggcgtcttaaaactccccgttaattccttgatcttgtcatacattaaaaggtcgggatacatccgcttggtcgaacactcaatcgcgagcattttaatatcataattgggatcattcggacttaaatttaacccccgcttcatcgtgaagatcaatttaggaaaaatcgcagttcggtgctccttaccgagtcccttgattcgaatctggagaatcgccttttgaatttctcgttcaatccaactagttcctagaccaaaattgaccgtggtaaacggcgtctggccctgtgacgaatataacgtattgatttcatactcaagggcttgcatcgcgtcatagatatcttttttagttttggctttcgcataagcttcccgctgatcggcagggacccactttttcgcatcagtcatatgtttttgatagttgattgccgcatagggagccaataattggtcgacacggttagcggaacagccaccatactgtaatgaagccacgttggcaatgatctgcgccatttgcgctgtggccgtttgaatcgaccgaggtgaggcaacttcggcgttcccaattttatacccatttttgaacatgccgtcaaaatcaatcaagcaacagttcgtttcaggcgtgactggtgaataatcgagatcatgccaatggatatcgccacgcagatgggccttagccacgacatctggtagcatcttcaagcccatggcgcgacttgcagcaccggcttctaagtcgcgttgcgtgttaaaaatcgtactatccttatttgcattttcatgcacaacgctggcatcgcgctcaaacaacttttcaatccgtccttgaacattagttgctgccgcaaactgctgctgttcagcttcaaagtaatcctgatatgccttagctgccgcggtcaggccttgcgcattcaaaatctgcatcatggtactacgtagctcccgagtatcaatgttgtcagcatcttgatactgggcaacaagggcctgcttgacgacccgtacctcgtcatcagtcgctaacaactgtcgtaggacaaagtcaattttatacggatgaaatttcgtttgtgcgccaccccgctttgtgacggtcagtggccgtaattggtctaatatatcgttagttgtcgttgttagcattttaattccccacttttcaaagtcattgattgaatacaattgatagtgcgttctgtttgaatcaacactatatatagtagctcattttcattaacttgcccattgccaaaattaactgtcaccttcagttgtgtacaccaaatcgctttaatcgtccggttagtgcgtctttggaatatttcaaaaatatttttcatactattttttatctaatatcagaatatttaatcaatctcgttaactaccgaaccaaccttgatacggcttgctttcaatatttttcacacgccataaaccgaattttaattcgttaaaaattaagctgaacacaaccaagttgttgtaaactgattaacttatgactattttgtttaactcatgcggcggattcgctataatgaaattaagtcctcattgagggatgtggacattggaggagagaataattatgcaaaaaagcaggggaataatcgtcggcttgttgttgacagggctactgacaggatgccattctgccactgacacacaaacgcccaccgttcaaccagcaacatcaaaagtcagcgccgttcgctcagtcacgactcgggatttcttaggtcgctgggtcagcgctagaccagcaatgagtctgtacctcagtaccaatcatcaagttgcttggttccgacgcggacatacgcccattcgtagtcgcgcaacgttaacgttaagtgatacacgtgccacgttcacaatcgatcacaatgttgcaaaactgaccctcaacgacgctaatcaaatgaccatgaattatcaagggactaatatcgcactgattaaagatccaaattggcagcctgaacacaaccaggttcccaccacaactaatgacgccttaaaggcgggcaccttaacgccaacatttaaattgtcgtactaattgaaggccacaccacatttgcacgttgacttgtgtgagtgtggtgttttttttagggcctgacaactagcgaacggcttgcttctgtcaaccgtgctctctataattaaattaatatgactaatcaatggaggaacatcaaatgattcgaccaattgtgcatgatcccgccgcgcttagtgtccctgctgacttagcaacccctgcagacactcaagtcttgactgatttactggataccctcgccgcacacaccgataattgcgttggaatggccgcgaatatgattggggtcaacaaacaaattattgtcgtgcaactcggtccctttgcaattgcaatgatcaatccgaagatcattgatcatcacggcacttacgagactaaggaaggctgcctgtccttacctggtgaacgtccgactagccgctatcaccaaatcacggtgaaatataaagatcaacactttaaaccgcaacaacaacgattcaacgacttcacagcacaaattattcaacacgaattagatcactgtgcagggaaactgatttaattgtgcctacttctaactgagcgggaataaatgtttagtttgctgaactcgttgatatttatgaaagataggactggttttatgacaactttagcttataatggcgagacagcaattcctgcactcgctcagcagcgtcggcaccaagctcatcacgcgctcggtaccgacattgatttgaccctttttggtagtgatagtgaccagtacctacaaactgcttgcgatcttatcgaccaatatgaagaccgcttgaccgtcaaccggactgtttccgaggtcatggcaatcaaccaggcggcgggccaacaccccgttcaagtgagcgccgccacctacacactcgttcgacaagctgtcgaactcagtcgacaacattttggtttcaatgcgttgattggcccgctcgtgaaactctggcacattggttttactaacgcgcacgtccctgaacagtctgcaattaacgaacgattggccttgatcgaccccgaagccgtcatttgtaatgacgctgatttcagtgtgcttctcaaggtcacgggaatggagctggatctaggcgcaattgccaagggctacattgccgaccgcattcaagattactgggaagcgtttggacagcgggccggaatgatcaacctaggtggcaatctgttaatggtggggacgtccccacttcatccggatgggcaatggcgcgttggtatccaagatcccaccactgaccgcggtaacgcgattgccagcgttacgattggcccctgctcggccgtgaccagcggtatttacgagcggcaccttgaatttaacggccagtcctaccaccacatcttagattcgcaaacgggttatccccgacaaaacgaccttgaaagtgtcaccgttttctcgaaagcttccattgatggtgaaatcgaaacgacgcgactcttctttgcgggccaaccgattcccgattgggcaactcagcgacccgatatttacggcgccatttttgtgactaaacaacgtgagcttcaaatcgttggcttatcacctgaacaagttaccttactcgatgaccggtttacaataatttagaccacaaaataagctaggtcctccaagaaatcgacttcttgaaggacctagcttattttatggcccacttacaggctagcatttaatttgcagttgactttagatgcggtacgttcgacattaaaaccattttaatcaagcatagctaaatggcaaaaatatagccgttttagttaaaataacgcgacctaatccgctggtagctcagcctctaagcgatcaataatcgcacggacatcatccgttgtcttcgtctgcattaattcattgcgcaattcggccgcatgacgcataccgcgaacataaatcttaaagaagcgttgaagcggtgcgaaatgcccttgtagacctaagccaataaattgatcatacagatctacttgataccgtaacaattctagcatgtcacgcgttgaatgaggctggggaatcggttcaaaagcgtatgggttctgaaaaataccgcggccaatcatgataccatcgactcctggatgggctttggcaagcttcagaccagcctgataatccaggatatccccgttaatttgtaatagcgtcgctggtgccaaagtatcacgcatttgaactaaattatcaattaactcataatgcgctggtaccttgctcatctccatcttcgtgcgcacgtggaccgttaacacgggaacctgctgttgcaacaaaaatggaatccaagtctcgtactcatgcacatcgtcaaagcccaaccgcgtcttaacactaacgggaagctctgcttgacgtgcgccctcaatcacttctttggcacgatcaaaatgtcggattaaatcactaccactatgatttttaatgaccgccatatctgggcagcccatattaagatcaatggcttgataaccttgattcttcacttcatgggccgctttcgtaaagtcctcaccactattgccccaaagttgaacgattggtcggggcgactcggcctcatcaacatatagtcgtccccgcgttgtaaacttagccttcgggtgggtaatgcttaacgcattcgtaaattcagtataaaagacatcgggggccgcagcgcgcatcacgacccggcgaaaaacggagccggtcacggcttccatcggtgctaaactaaaaaacggtcgctgggcggcctgagctttggccgcgatccgttgccaatatggcgactgcgtcatagttattcattcccttctagataataatcacttatccataatagcggtgttccacgttgaagcgcaagtattttggcggccacactaacataattcgtcaatcacaagccaaaataaaagtccggcgttaaccggactcgcaataatagctaagttgataagtttaattgtcgctttaacgaattaaaaccagtgcccacagcaatagtccaataacgagtaccaagtttaacaattccatccgcaaatcagcgaacttcagtgagctgaatgagataccggcagttgtatccatatatcggaagaaaatcccacttaaaactaaaccaactaacaatacaaatagaaccatcattcccgtcatcatcatcacaaactcaactccttatttagtaaaattcttgggctctttgaaaccatgtttatagtagtccagcagctactttcaagcaagtatttccggccgaaaaacaggcgttcttagcatattattattaactaaacgataccaatcattcccagcaaaaaagttctttccggaacaactaaaactccgaaagaacttttttaaatcgccattaattccgccgtcaacttagtcgctcagactaaattaaccgactggactagtcttgcacttcgaaataatcattgagaaaccgaattgtgcctacacacttgttaattaatcagttgttttatggcgccgttgttgcttactaaaaccaaataagctagttgcggccaataatacgaagcccaatacggtcaaaactcgattggtttgttcaccagtctgtggtaacatggccgttttagttgcggtcgttggcaccgtctgctgagtcactggcttagccatggccggactcgtcgtcgtccgcaataccgttgtggcttgtcgtggctgcgtcgtaacaacccgctgcgctgttgggacggaagctgaacttgactgattaagagtgggcttggccggggtcgcttgtgatgccgccgactgattagtactggttgacgtgccagttgaatgactaacgactggtcgttcgcccacagttttttcagtcattggcttttcggccgctgctgttaaggttgccaaggtccgagcgcgcacggtcgttaatccagcttgagcttgggacaattcccgctgtgcagtaacgatctgatcttgagtacccgcaacgcgctgcaacttagctgtcaccgctgctttcgcctgattaactgctgcttggggctgaacaatatcataatctctttgtgccatttggaagtcgcggctcgtgccactgacttcaattttggcgttggctagttcttcttctgccatcatcacgtgctcattagtcttatcaaggttagcttgtgccgctgttaacgtctcttgcaccgttttcagcttctcctgagtagtttgtaacgtgactttgttggccgcactgttatccttatcgaagttgctctgggctacttgaacagcagcttgtgacttagtcactgccgcttgcgccgtcgttaccgcagtttggcttgtctttttagttgccaattgttcatctagtgctttcgttgccttgacgtgccggtcagtggctgcttgcttaagtacgcccatatgcgtctgaatcttttgattcttggctaacgttttgttggcagcgtctaacgtggtttgcgccgcttgcagatcactcatagccgttttgactgccgtagtagccatggttaatgcttgcaccgcttgtgttacctggtagtgagccgccttaacagctgggttattttcgacctgacttgctaaactgaccgtgccattcatccttactgcctgaccggttcgagtgttagattcggctgcatgtaccgtcattttctgggccatgatgccccctgttaacatggtgattcccatcactatcttaagcgcttttgacatactaaactaatccccttttaaaaagtattgcccagccatgaccagcatgatgatcaatatgaaactgctggaactatttcattttgccggattcaatttcaaaagcaaggaaagctagtgattcagcgtatttgtaatcaccaaccactcaacaactttcatccacatcaccaaaataattatatctagatgtcattactgcctccctcaacacgagtccccatccacaattaaacggtaacgaataatcatcaccgctaacaaatgttaacccgcaccatgattttattagtgacccattctcaataaaaaaaataactaatatttcgattaccgtagcggcctcacaatattgatactaatttataccgttacttaattaggcgggcctcgccatcggtgttagaatagaatttaacctaaagaaaagtgtgactgctatgaccattaatgacctccaagcattcgtgatggtgtacgatttacgccacatttctaacgctgccgtagaactccacttatcacaatcggaattgtccaaacgaatgcgagcccttgagaacgaactgaacattaaactactagatacacacaacaagcgccgtctacaaatcacgccagctggtgaaacgttctatcatcatgcgcataaaatgattacagactatgagaccatgatgcacgatttggcaccgaatcggccaacgacatttgccaagctcatcattggcgccattccaatctcaggtcaatataacattgccaaaaagatcgccacttttgatactcagcatcctgatactgaaatcaaaatcatcgaggatgagggcgaccaaatcgtcaaacggttactgagtggtgagctgcaagcggccatcattcgcgatactcagacgacccaattgcaacccaccgaatttcaaaaacaaccactactcgctgacgaactcaaaattattttaccgcgtgatcaccccctagctgcccagccagtcattcggattcaagacttagcgcggcagaaaattgcaacgttaccaccgggctccggtgtttacgaaccgatcatcgcactctttgctcagcaaggcatgacgccccaattcttctttgaaagtacgcatattgaaacgctcctgggcattctcaatcaaaataacgtgactttcttatttaaacaatcggtacttccgttcatgactgaacacgtggtcatgcgctcactcgccatcccgttcatcagtcaactgaactttgtatatccccagcgaacggggaaccagttactcaccgacttaattgactacttgacggtgactgcccaggaaaatcaacaagtttaaaaaataccctttccatccgaccaaccggccgtttgaaaagggtattttttaaacttatccgcttatgccaacccaacgaggtggaaccagaacatctcaactaacgcaacgacaaagacaaccgccgtcagtgggattcctaaccgcatcacgtctttttgtgtgtaacccccaccagtatcggggtcgcttccaactaagacagcgaggttgtggaacggtaaaatataatgcaagtttgtcaccgagaagactagtaacgatacggccaagggtgaaattcccatatgagccgtggccgctacgaaggccggaatcgtaatccccatcaccgcaatgacagaacccatgaacatatggataatcatggcaaaaacagtaatcacaatcgctaataaataaatattagttggcaagttgcttggaatcaaggtcttcgcaatccaattattcatgccagtcacaccaccgacattcccgattgcgattgccgaagtcaagaacacgagcacgttcacgggaacaccttcccatgatttggccgtcaagatcccgccaactaccgggagactcatcatcagcgcaacgatcaacgtcaaccaaccaacgtccaaaccggtgatcccactcgttaaccagagtgcaatcgcaatgatcagccaaataattgttcgaacttccttccccgtcataccacccaactgggcttgttgttgctttaacgcttccacatcgatgtggacttcctgactaggcttgaagaggaataagaacagaaacatggttaagatggccgcaatgatcatgggcacgcccatgtagataaagtaagagacaaagttgacgctttgaccagaggcctgtactgccaacggatttagtgacgtgtcaccagtataaaagaccccggatagtggacaggacgcagcaaagacagcgaggcctagcttagccaaatcgcgtttgggcatcttcgccgtttccgcgaccaccgtaatgacggacataatcatgaacgcccgaggccatggatggggaatcaggagtgcgaggataaaggtcagggcaaaaatcgaaatcacaatccctttccaactccgcacaaacttgataatgaatgcgtacgcgatgcgttgacccaaaccagattcattgaccgctcccgcaatcaagtacgccccaattacgagccacataattgaaccagtccacgccgacgagaagacctgtgacggtgtcgccacgttcataataatgagcaacattaagtaaatcccaccaacgaacgcgggttgcgcgatttgggtggcccaccagacgaccgtcatcaaactaagtgccaagtccatctgccccttagctgacaagccggcaatcggtaagaagtaaataatggcaaatacggcgattccactgaaaaagccaatcgttttcttgttcacgagctacatgctcccttcaattttgacagcaaaaagccccccgaccagcacacttccgttggtctggcggctctttgtaagattaaattttggttcaatgcgataaaaatacgctcatcaagtgcaatggatgacgttacttcaaatacttctcccagtcagccactttcatgaattgggcccgttcaaattggtccttcatatcgaatggtacggtgccatcaatcactagtttagaactcatcccacggaaacgaatcgactttggatcatattgtgggcgttccgatgggtccaacggatgattccgcatgcctgataagaccatcaagtcctgatcggcttggaaacgggtattcatcgtccaaatcacatcattcatatcaaaaatatcaacatcttcatcaaccaggataacagtcttcaattccttaaaggctgagaacgcaagcaaggcagcttgccgttgaattccttcatccgcttcattatccttgtgaatctgcatgatggtcatcaacttaccaccaccagccggcggattataaacattcgtcactttaccaggaatggcacggttaaccaattgtaagatactagcttcagttggaattcccgccatgctgacatgttcttcggatggtccaatcacgctttgcatgatggcattcttccgatgagtcaccgccgtcaccttaatcacttgtaaagctgggttggcgtcaccatcataacccgggaattcaggcatcgccttgcccgtatgcgtattgatatcttcctgaatacgttcgttaggcataatgtacccctcaagcgtatattcagaacgcgcaatcgccttttcatcgacggtcaccccgtcaactaattgaacagcttggttccgaatcgcaccagcaacacctaattcgttataaccgaatggcgtggtcggtggttcgaaagttgcaccaatcgtaatagctggatccaaaccaatattaattgtaattggcattggcttgttagctttctcatactcttccgcaaacgcaccaatgtgccgaccgccaggcatgatataaatccctaacttatccttatcttcaaggaccattcggtgaatcgtcacatcactcttagacttgtccatgcttgagccaaacaccacaccgaccgtaatatatggtccagcatcttggggcgtattcgttggtgctgccactaacttccgaatatcaaagccttcatccgtcgctttataaacaacatcgtgagctggcgcatccgcttcagcaaccgtttctggcgccactggattagagactgcttcgttcaagtattgccctaacgtctgataatcgtggtggaacatcttaccaacgcgccggcgactcgccatcaatccagtcaagacccgcgtatcaggaaaccccttaacgttgttaaacatcattgctggaccctcttgcgttggccgttgaacggtcccaccagcaccgatataccgataaacaccagaaagttccgcatttggatcaacttcgacgtcagtttcatgatagttctttggatcatccttgatctcatcaagcacgcgacgcaaatcccatggttgttctgccatttcattcatctcccttaaagtttacaagaccatcatacggccactcgtaagcgggttcaattcggattgcgcagatatgttattcgtgaatggaataatacaactaaacgcattaggtcgatgattgttatgtattaattatgattgaaacgtgctgatttccaaagtcaaaagcagccagcttaggcccgctggaaaaagttcgagttagcataaaattgcttagttggcgcgtcttacgccgacttccaggcatttctgccaattgctggaacgccttccagtcggaacagtgttcgaatggcggacannnnnnnnnnagctcaaatcgacgtcggctacgttccagcaattgtcacccagccccggaggtcggaataggacgcgcaccggctgacgaataacaatctaaacttggcacgtttcaatcataattcatgactaacgaaccggcacagtatttagccgagtcgtatttttagtgcgtgacgtgtcgtttattgtgcaaactggggcattactaaataaatacgccgtgtaaacattgataaacagtttaatcatgtttatactttaaaatatgttaataatttttagactttcttaagttattaacgatgattagtcatccaatagccttattcatcgattagcacttattattcatattcaagtgacacgtcttattcagaattttaactcgattgatagtagcggctatttactgtgaagactccagtaaatagttttttattgtcgactaatcaatctatttttggaggagcatcggggaatgtataaacagcaccaattttttaaagccgctgacgatcgtcgcggccaagcatcgttttgtcctaactgtgggcaagcggtggccgcaacggatgaattttgtcctaattgcggttttaagttgcacgcaaccactgatcagccatcgccatcagtaaacaccgcgcagtcaacaacaagttcgacgcgcaaggttcgacaacaaccccaacgccatatgccaacttggggttggggtctgattgccgttatcgttgtcattctgattggcggctatctgtatggacagaattattatcagccgctcaatcagctcgaccgtgacttaaccgcactcaagactggaaaaggtttagcgaagcaagtaactagcactgacccatcactcaagattacaaatgatagcgtcaagccgatggtcacttactttaaaaacaatcgaaaatcattagcatcactggctagttcgcttaaaagtcgttctgcgactaatgattacggtattcagttcgttaaaacaggtaaatcctggttgtttttcgataagtatcaactacaagtcacttctgtttatgccacactggcgacgaaccaccgtaacgttgcactcagcgttaatggtaagcacgtcgcaacatctaataaagcaacttacgagcataaaatcgggccgtatgttcctggttcatacaccttgactgccaagggaacggttagcggccatcagattaccaataagggcacctattacctccgggcaaacggccaaacttacgacttagatttacgtacaatttccttcaccgttaatggtacaccgaataccaccgtttatatcaatggcgaaaatgaaggaacgattaacagcagtggcacactggcgctgaatgatattccctggtctaatcgcatgatgttgactggtaaatacaaagccggttcacaaacattgaccgccaaacagactaacgttagtgacgccgagggtcaagacgtggacctcaaatttgctggtgtgatgagtaaagatactgcctcggactacctgaacggtatcttcaccgctgtcagcagttatacgtccaccggtgacctatcggatgcttcggattacgatgaccgcactttggacgactacttcgtcaacggtaccgataacactgactacaaagaactggtccaaatggcgaagggctactacgacaatgatgacgtcctcgatgtcacctatgaaccgactgtcttatcaacggttccagcagctaagcaacaaagccagatcacttatgacgtcaaatatgactttaccaactctgaagatgaacgcattcaggtctttcgttacaccgcgacggtcgagaaaaccggggggcactacaagattgttaaaatcacgccggcccaaaaaattcgatcgtacactaaatccgatgattctgatgattaatgaaggagaatttaacttatgaaaaaatgtcccaactgcggcactgagattgctgccaatgcaaagttctgtacccactgtggttacgatctaaccaaagcgacaccggcctcggcaacggccaacgccacttcagccacagctacccaaacaacgactgcaacgacgcaagcagctgtccataccagcacagcttcagccaatcaacaacaatcggccagcgctgaaaaacaaacagcatcacgttcagtagcagctgctgatacgacacggacggctactaaccaacaagtccaacagctgcaatcatctgctaagaattattttagttggctcttggctagctggaaaaatcctagctgtgaagtccgaactgaaagttattttagttacatttcctttgtcattgaagcactattcatgacgttggccgctgtaaccattagtaataagtttctgaccactgccaatgacagtcaaagctatttccacattagtaaattagctttttccaccgacttaaagattttcttatgtctcctaatcggcatgtgcttctacctggctgtcggctatgtcacttgcttacttggaagtcgtgggaccaaagtcggctttacgacctatatgaaacgcttcggtcagttaaccaattacgcaattattgtgaacctattattatggtttgcttcgtccctagttaacttcagtgttgataacttctttaccattgcggctagcttcagatggtcgattatcctgttgagtgtcagtgtccttgtctggcaattaggtttgatcttcgtcattaacaagtcggtgacccaaccattaattagccgcgtctacctagcccttattgcggttctagtcgttagcctgctgttctactttatggataaaattattctgcaggatttacagactgcacttctcagtcacgcaactgactttgccaatcaaattggtaacttgttcggtagtcaatactagttgttcgaaggtatcacaaataaagcctcgtaaattaacgcttatgataatgcgttaatttacgaggctttttatattcattagattgagcaaattaatttgtaaccgataacagggtgctactcgaatagtgtccgcttgagctgacggctaacaccgtaacccaccagaataatcgttattaaccatccggccgtcactagtgctttcccgattgcgatgattcggcgcatcgtcccacctccaaaatgagtcgctggttcagccattacgcactcaaccgatgactgaccgatagtaactcactaaccaataagttttcagttggcgtcaagcgcaactgtttagtaaaaatattataagtcacgtcattcgttaaccgcttaattagcgcatgatcaagctggggcgcctgtttcaattgttggtgtgccttcaatagtgctgcccgaatttcttgattcgccgcagttggtgctaattcttgatataaatcttgaatgattccctgtacttcacttttcacgttgcacaccttactttcagaaaactaactactcttagtataggcgtcttccggtaaaagattaaggttattttcattgaacattaaactaatttgtcagcaccgcctttaaactcaccaacgttaactaacctaacattatattaactggcgtaagtcatcatttaaacgcggccagtgctaattggatcgcggtagcgcgcacatcgccgctaaagcgatggtcaccgtcctgaacccaatgcaactgactgtgctgatagacctcatgatacttttcagaagcctgtggcgagaccaccgtgtcggccgtaccgtgaatcaatgtcaccgaaccggaatactgctgagctacctcataaatcggcaactgttgcgcggtccgcaaataaaagccaccaactttaaggccatcacgaatattcaaataggccggaatatgttgtggatcataggtcgcaccttgcagaacaccttgttgcgcatcggactttaacgttgcggccggcgccatcaagatcagtttgtcgaccacgtctggataatatcctgctaacatgctggctaccaccccgccttgcgaatgccctgccaagacaatgtggtcataatgtaaggtcaacgcttcatctaaaactgctttagcgtccgcaatctcattaatcactgtcatatcttgaaaccgaccttcactacggccatgaccattgaagtcaaaacgcagaactgccaagccgtgagcaactaatgcctgcgccaattgcggcacaaattaggtcgtatcatatcccatatcggccgtaaacccatgcattaagatgactagcgttgagctcggtgccgccggagtctccaaccttgcctgtaacgccaacccatcccgtttaatcttaaattccatcgatgtcatctcacttattcattattcacacctttaatatagtggatttacgtcccatttcatagtcctgagcactcaccctatcctgaacaaacagctaacactatacaaaaaacctgtttccatggccttcacatcagtcatagaaacaggctcttaatatcggctggacatcaaacgatttccaactgtagctgctgcgattcgacccactttgccgcaactagaatgcggtacagcacgattgaaataactgctggcatcagcaccccagtcaagagatagaccataaaactgttaaagttcgtcgatgctaacgaaatcggtgcaattaacgaattcaatcctaagccggccagcttgtaactggttgaaaaatgaaaggcaatcgtcgctaccggggcggcaataaccgcagcaaccattggtggaatcgctaaccgtggattcaccagcaagtttggaaattggactttaggcgtgataatcccctgcgcgatattggcccccaagttgttttggcgaaaagacataatcgtaaagcccacgaactgggcggttgttccaattaaggccgcgcccgatgagacgggatctaacatgaccgccaccgccaatgcggccgaagacgcaggtgtcattaaaaataacgcccaggcaagtgaaacggccatcgaaccgatcaatgggttgaccttcatcgaagtcgcgatgaacttgctcagccagaccaatgcgggcgtcgttacggctgctaacccgagaccaaccaccgcaccgacaaaagtggccgctaacgggaccaacatcatatcaagcggcgtcttaccagttaaataattaccgatcagaaccgcgactaacccagccgcaacggccgaaatcggttgaccggtggtaaagatcgagctctgagctgcttgggccaacgtatgccccgtcgctgtgacgccgttagttgcggactgcgagaaaaagacggcgttcgccccgatcgtcgacgaaatcatggcgctaaacgtaactaacgtgttgctgttgagcatcgtggcaatcgcgactccaaatgccggtcccaataacacttgcgcaatcgcaccgacttggtataatgccgcccagtgaacaaaattcgcgagtgactgcaataacaatccaatccctaaacaaactaaaatagcattagaaacacctgccgaaactttataaacgtaatccatggtactcatcttatgtgtcgcggtagccgcggtcgtagttgcttccatatgtaggcctccctttaaattaataagaatatgattagataaaaatgagaatagctacatttaaccacgtgttttgaaaattgtcaacgtattttcatcacattatcgttgccaactaaacgaaaagaccagccaggcacgatgccctcgctggtcgctttcactcatcgtattcaaatcattggcacaagccatcaatccaggaaaataaatcgcctaaatcatagtcaccactgtggggaatatcccacggtagcgcaaaatcaatgccataaccatgattttctaacattattgctagaataatcgggattgcaaaactcgtatctcggtcggccgcaccgtggcgaatccgccagtgcttagcaacttgtgacgaagttgtcgttaagtaactgagcggattaatcgcctgaatcagctcagcgtccgctagttgtgcagtcaccgtacttcgcgtctgtgccaaggccgtaaagtgcttggctttcgccgttgcatcgccaaacaaattattctctggactcgtcaaatctaattggtcaaacgccgggacggctttcatgcgagttaacgacttcaaataagctgataaatccaagtccgtcacctgatttccagtaacgacaaagcctgcgtacttatgaatatccgtcccttgatcgaatgccgtctgagcagatgatatcaataattggcgaacaacatcacgaaatgaacccattcccgcctcattaagcgtcaagtgcgtcccgtcactggccgtgagtttcaactggttcaagtaagtactgaactgggcttttaacgccaacgaaagggcctgttcttcaactgtgagctgaccactaaccggttcaaattttggtcgcccattcttggtcgtccccgcaacaggctgataacggtgccagtcattaataccattaaactgccactcgtaggccatgtctgcgtgttccagattatgaatcgggcagtaagctgacaccgcaaagatatcgtcagtcgccggtgctgccccgagcgcagttaaggctggttcaaaataagccgaattgccactcgcacccgctaaagccgaagtggcacccccagcactcgttccattcgtgatgatccggttcgcgtcacctggcagccggccctgattatacttaacgtaacggattgccgccttcatatctacgataaaagccggcgcttgcccgacccgttgcccagacttatcaaccgtcgtacgaccgcgaattccagcggccaccacaacgtaaccgcgcttaagtgcctgttgaatcgtccctgcattcgtcggccaagtgacacgttgcggatcatccgccggtcctggcaaataaccgccgaccgtattcggcatcagaattggcgccgttgcccgctgataaccattgactgaactgccatgcaagtatgcggctggtacaaagacgtttaggacctgaatcgctgcgactggatgctgaacgtactgaatattacgggcagcataatattgaatagcctgcccggcaacttggacctgttccggcaccagccagtcagcatcaaaaatcaatcggttactcatcttgtgacctccatttctatctattcgttactttacccccattatccagttaaaatcaaatcgaattgcgcaaccagttatgccaattgcgactaataacgattaacgtagtcagcagccgcttgtgaacccgtcataaactaatgttgccgtgcgttaaccagtgagcccttctaacgaccatggtcgccattgctaactaatctaactatttcaagttagctattaaatgaccgctaactaaaaacggctttctaaattaacagaaggccgttttaaaaaataacattatatgtgcatcattttagggctatcagttagccttaaaaccaatgacggataagtgcaccgccacctagcgttaatacacctaacaaaatgccgactgaacgaagcgcttgactgtccatcttagcttcgttagtttgtggcaatttagcaacttggttaggcgttgatgaggtcaacgcgtcactttcagataccgttgtcttagcactagactttttagtatccgctgctggcgtttgatcagcaccatcttggcccgtcgttgtgttagcgggcgtactcgtaaagacactcgaagttgaatctttcaatggttttgacgaattagtactgttggaagtcgtactcccatcgtagttactatcgaacccaccatcaacatcgatggtcccagtatcttcatcgatatctggataaaccgccgtattatcttcgggatcttcaatgtcaccagtctgatggccattgtctggttccgtagtcgtattgtcagaactctcagaactagtatttacatcactcgagctttcagaaccggagtggtcagaactagagtccacagcgcttgaactttcagaactagagtggtcggaactggagtccacaacgctcgaactttccgaactagaatggtcggaactggagtccacagcgcttgaactttcagaactagaatggtcggaactggaatcgacgtcactcgaattatttgagctagagctgttcgaactcgaactggaacttaagtcgccagtaccgctcccaccgttaacgactttttcgtagaccttaccgttagcttcttcgctgttcttgccaccggacgtgccgccgccccattccattacagctttatttttaaaatgataattttgatcaattaattctgtatccgtaattttagtatagtaatcgatgacaactaggttgctgactgtatcgttgaatttcaagtcaaaaccattatcgctgtagttaacttgataagcatcgtcactaagcttatcacgccgcttgtaagtgttggcactcgaccattcaccattgtagacttcaatacctttgatcatttgctgatgatcaccaatggtatcggcaatcgataagtttttcatggtaatttcacgccgatcaacaagtaaggtccacttaatcgtgccattttctttatcaatggtgccttttttagacatattagcttcattagcaaccatattgatcactgatgtatcttgaccgtcttgggtatcaaacacaacgtcttgttcccctaagtcatcataacggtacttcattcccaggttaacatcaatcttaacattagttttaccttcaatcgccgaattcatggtcagtacgacctgaccattcccgccgacgacacccgtgccaatcacagtaccagtctcagtatcagtcacatcaaaagtagccccaacggtccgtggttccaaattagccggcatatcaatggtaactgtgtcccccgctttgaaagccgtatcaccaaaactcatttgatactgaatttgaatagtatctgcgtgcttaaaatcagggccattgatgaccgatgcggcggttgtgtaatccttcgcatgataattagtcgcggcttgggcccctagtggctgactaaatagtagtaaaattgcaaaacttactaacccaagtagccagaatagtccccgcttacttaacttcataaaaaaatccccctcgtaacataatatccttcatcgaaaagtatacgctagcaagatggattttcaatagaatttgtgaataaaacgattaatatgttcatatattgtttggttcccatctataccaatcaatgctcacttagagacaaactgattggcgcgtgtcgctgcaaattgcaaaatagttaccccgacaatcattatcgccccaatcagtccgacccagttaaagtgaacgtgcaaaaataagacgcttaaaatggttgctgctaggggttcaatagctcccagaacactagcagtcgttggtaggatgtattccaagctctgtaaaaagaacaagtaggccagcatcgtgccaaaaatcacgacgaagccgacttgcccccacgccacccaggttagctgcggcgaatggtgccaagcacctgttccgactagcaccaagccaccaccaatcagcattgaccaaccaacaatgggtgtggcgccatacacttttaataattttgttggcattaatgtgtagatggttgcaccaaccgcggccaacaatccccagataattgcaattactggcaaagccagcgagtcagtgtgcccctccgtgacgattagaaccgtcccagcgattgctgagaccacagaaatgacgtccactttccctggaagctgccaagtcgtggcggtgataaagataataatcatcaccggtgacaagaattgcaagattgcggccatcgccgcattaccagtactgattgccataaaataagtcaattgaacgccagccatcccgaacaggctgaacacaatcagacgcaccgttgcccgccagtcatgaaacacggccatgaccggtaaccggcgactaaatccatataaaattaacagacctccagatactagcatccgcaccgccactaaccacaacggcgaaatcgttgtggtgtcaaatagatgttgcgccaccgttcccgagcttccccacaaaaaaggcccggcactggctaataacagtcccaccgttttcttttgcatttaaccacctccaaaagcactagccttagtctaacaagcaccagttgactttccaatgatcttttcaaattcaacttagacagtccgactgacaaacctgccatcacaccactttaagcaccttatgataaatttcataattgacactgtaatggtggtaagctaatcttatagcggggtatggaggtgccaaatgaaacatcaaaaattaatttattggttggtcggaatctttgctgtcgtcttcattggtggcgcattaatcattccaacaccaaccattaagcaacaggttgtcagtattggcaacgccattacggggaatactaaaactaagggcgctacacacgccgtttcggatagtgcccttggtgaaaaatatcaattatccactagtgaaattcacgtcctgcgcaaacttaaagtgacggggatcggtgattcaatcatggtccgcaccacgagtgacttaaaacaaatctttgaccattttaacgttaacgccaaggttggtcgccaagtgtcggaagcaccagccgtcattagccaattaaaagctgataatgcaattcagaaaaacgtgctgatcaacttggggacgaacggtccaacaagtgccgccgaaatcgatgggatcattgatcagattggcagcaaccaccagatttactgggtcaacacccgcgttccaggcaaagattggcaagaccctaacaatcaattgattgccgcggccgctaaaaaatataacaatgtgcatctcattgattggctatacgttgcgcaagacaacgacaactggtttgtcaaagataatttacatcccaacagtcttggtgaacgtgaatataccgcaacagtcggtcagacaatggctaaaacagcaacaccatagccactttatttttagacgagggttctgattacttgcattacccgtacagcagattagcccaactaattatgctaacaataacgtaaaaaagccggaacaccagtaattaacaggtgttccggtttttaatattggtcacgccaaaaattcaacagttatcctaacatcacttactcagtcagtaagcgatgggcgttatcgtaaaagatcgcttgtttctgctcatttgttaatagatcagtcgttgttaaagcgtgacctaattgccgcgagccatctaacggcgtatatggaatatcactcccgtaaagtaggtgctcaggctgagccaagctcattaaagtttgcaactgccgtggtagcacggctccagctacgtcaaaataaacatggtgcatcacatcataaacatccacctgataaaccttctgcgcatattgtgcgattcgatcatcaacaattcccaaaaaagcaccagcatgcggtataatcaccttgatattaggatatttttcaaagaagtgatacttcaacatattaataaacgtcatcgtggtatccataaaaaatcccaacaacggcactggtaaatcaatatcaacgtttttaggcaagattgctggttcatttggatgtaaggccacaatcgcttggcgagcatctagttcttggtagacccgttccaagactggtgatccaaagtaaagtccgcgtgagttggttggcactgtgacgcctaaagcaccatcctggtccaaagcctgttgcaccgttttgacagcatccagttcataaggaattggtagactcgccaagtatcctaattgatctgggtattgctgggctaagcttttaccatcgtcgttagccgcttcaactaagcgtagggtttctgccttatcgccgaagttcacgtgtggggatgataacgataaaatcgagtaactaatatcattatcacgcataaagttaagcgtaagctgtggtgtccactcaggtgtcggccagccatcaggatcacctggaacatgacgctttagtgcctcaacgtaactcgttggtaaatagtgggtatgaaaatcaatttttgacattatctgcacctcgttttttagaataaccatagtctaagaccaaacgagtgcgttggaaatgtacaattgatgtcaaattgaccatttacaggaggtgacatgatgacaactaactatccgcttgccgtacagaaaatgttcgcaactgtcccagcactactgacagtgacccccatctttaaattgactgtcaccatggtcgtcaaagcagcccacgttagtcgtgggagtttttacagtcactttcaagatatttacgacttcattcacgctttcgaacatgctttaatcgaacaagcaaccgtttcaaagcaagtccttaaccaagggattcaagctgccctggttcatccggacctgcataatgcttatccaacctatctggaactaacaacgaatatcaacacccaattggctagttttcaggccttgcttggcccccatggtgatccacagtttcttgatcagcttcaggccggtctcattgataatttactcgccactactgagcaggcgcccttaaatcatcaatatttccagtcgattccggctgactacgccatgccaatctactttagtggcgtgctgacaattattcagcactggctgactaaaccccatccggagccacctgaagtggtcgccaacattatcgttcagagccgctacaccgaggcttaccatctcttttccgaccgtccgcttggggacgataataactagaagccaaactaaaagctggtcataatcccataattgtggattacgaccagcttttagtcacgacagtcaatacttattatattcagtgcatggtcacgatcatttgatcgccccacacttccaactgatgcagttgcttttgaaaactaacgcccgcagtcgtcaactgaaattgatagttccctgcagtcgcaactaatcctaattcggttaatttagctaaaacattcagtagtttaagcgtgctaagacccctaactcgctggcgcaaattcataatctcagttggcgccgccttcaggttgatcagcactaacgcggcccaccggtcattgagcacgcctaacccgactttcgtgccaatatttagatcacgcattaccatcagtccatacttccttacttagaatttataatcattatgactattctaagtaagtttgcgttggaatgcgaataacttgcttgccatcgacttttcagacttttatttttgaatgtccggatacgtctgacaaaagtcaacgaccgctccccgtaaattagcttcatcggtgaaatgacaagccacaacatctggttttatagaagcaattttgaccgttgcccgcaatttttcgatttcagcattgattgctgggagtagatgcggattattcgagaccgccccacccatcacgatcaattccgggtcaaagctgtattgtaagttgtagatggcccgcgctaaggcccgaaccataacttgaacttcagcttgagcatcaacatcacccttggcagccagttcaaacacggcttgcccgtctagctcaggttgagctggatggctcgcgttgtaccgcttcgcaacagctaccgcggtgcctaactcacttaagatctgatggtcattcatgagcgtgaatccaaactcaccaccgaataagtgcgcgccgtgccaaatttgatgattcacaatgaccgacccaccaacaccggttcccacaattaagaagcacaggctagcaacctgcttcccagccccatccgccaattcagccaacgccgcacaattggcgtcattttccatactgaccggtaattcaaaacggcgttgtaattccggctgaatccgaaaattatgaatatacggcagtgcgctggcaccctcaataattccagttgccttgttgacagccccgggcgaactaatgcctacaccagcaatttgataatcgcgtttcatctgcgcgacctgcgtggttagcaaagtgtaaaattcagctagcgttgtgggcgtcgtaactttggtcttagcaactaattgctgatcttgccacacagcaaacttaatggtcgttccaccaatatcaataactcctaatgactgcatcgttttaccattcctttatcaattaaactagttatcataacaatgatagcgcttaatcaacaaaatgtatattcttttgtcaaacttcaaatacagtagttttcaattatctttcatgccctttaactagttgtatcaactacaaacaacggtctaagtcgatgtcagttccgttccaacaattgaaaatcacagaccagaccgcaaactaaacctaaaatactttctgattattttcatggaaataacaacttatcactattatattgtagtgttatgaccaactagatattttcgaaccctattcaataaagaagctaagcgaatcttaaaatcaagttaagcagtcctttttactatgacaaattgtccaattttaagggttcacttactgaaaaaaattcacttggagttttccattccaagtccttgcatagccagttatttaaatctgtgacggatgcggtaatttcttggtcattagatttaattatcatagttttgggaataggcaacagtaattccaaatcttgcatcattgaattattgataaaaacaccttttccatccaattatagaagattgcatgactaaatttccaaagatgacgttttgaatttatgaacattccaagaaatttaggtgatgttttatagctagacttgtttatccggtgaaacagtccataataaagctttatcaaaataaatctacggaggcgtgtctacggctgatcaactagtattagatactcaacaatggttaaactccacgtacggtgacgtcgctggatttggtagtgttccagaaaatggtcttactggctgggacacaatttacggtcttactcgtggtttacagtatgaactgggaatcactgatttagttgataactttgggccaacaactgcaaagctctttgatgaaattgctgatgatattgtacctggttattctggtaatatcgcatatattatacagggtggtttctggtgtaaaggcattgattccgccgcttttgatggcgagttcactagcgatactgtatcggcagttacaaccatgaaggaatacgctggattaagtgatacatccggtaccctggattctcagttcatggctgccctactcaatatgagcgccttcaccctggttgcggatggctatgaaaagatccgtacgatgcaacaacaattaaatcatgactatctcgcctatactggcattctaccctgtgatggcgtttatcaacgcgatacaaacaccgctttgatttatgctttacaagccgaagaaggacttgataccgacactgcctctggaacttatgggccaatgacgcaagaactgactccaactgtttcaactggtgataataataatcttgttcgtatactacaatggggtctttatgtaaataatcaagcgtatacgggggcttttgatggcagttattctttagatgtatcaagctcagtagcaacttttgaaaacgatatggccctaccagaaacaactggtgcatcagcaggattggacgttttcatgagtcttctaacctctgccggtaaccctgaccgcgatgctgttgcttgcgagacatctcaccaaattgatgctagtgaagccgccgcacttagctctgctggttacaaatacatcggtcgctacttaactgggacagccggtactggaagcagtgaggttgataaaaacctaaccaccagtgaaatcagtatattaactaatgctggtttgaaaattttccctatttatcaagacggtgcatccgatgatgaagactacttcactcaaactaagggcagtagtgatgggcgtaaagctggcttagcagcgatgcaattaggtttcccggatgatacaattatctactttgccgtggacgtcgatattcaggatggtgacatagctggtacggtcgaaccatacttcactggcgtggcaagtgggatcagtagtttcgggtttcaagttggtatttacgccacaagaaacgtcgccaatacgattattgtggatggattagccgaaaaagcttttgtatccgatatgtctactggcttttcgggtaatctcgggtttccaatgcccagtgaatgggcctttgaccaatttaatgaggttgcttttgatgatttttacattgataaggtagcttctaacagtagccgctcgacggcagtggatgacttctcagctggtagtagcgttggtggaagcgatgatttagacgcaattaatgaaattattcagaaactaggcaatacaaatacttactttaattttgtgaaatccgtctcagttgaagcgtttagtgacacgtacacaatttcaacacccgctgctgatttttctttaaaagttgatttagaaggaagcattagtgacgacgatggtaccgtgtcagcgacatataaggtaaatgatggtagtaccagtttttctgttagtgatgcagtccaagagttacttacacagaatgaaactgcattaggttcatctgatatgacaaatgctatgaacgaaattgcgggtgtcataaaaaatggtgatatttcaagtaatacatctattaaaacttctctcatgacgattaccctgaaaattaaatcaacgtttgagcacactgccagcaatgggaaaacatattctattgaatatgaaattacacttgacattcacttccatgaattcatagcgcccctaccagttaatgttactcaaactcaggcaactgattataataataatctaaagactattttgagtattcccgcaaatgctctagactatattaataacttgcatccagatttacaattcacacccacgccagcttcaacagaatcgtccttagcagttatgatgatgttcattatcactttgttagcggctgttgcttgataataacggttttgagtaccaaaaattataattaagaccatgtaagggggatgcaaatgcaatctaactcggttgcaaacactcttagtactgtgattttcatagcgttaataaatctctttataatagggctagttattctttgtttgccaagcattaagatgcgagccagtttcttcaacctccgagcacgtatcaacgccagaaaaaaatatttattagagccactaaaaaataatccaacagcaaagaagtacctaatcggctattttattagtagcttcatagcggctctcagtactggaggacaaattttcataatggcaaatggatatccagtggaggccacaataattaattgcgccgcttatggattcacttggtggttcagtcgtacttcaaaacttacgaggaattattgggagcaaaataaaagtgggtattcagagtttcgactatcatcagctaacgttttctggcttaaacagattcttcttaaaactattttagtggatggcatgattattagcatttcattaatgacatacatggtttgtttcggccataaccgataatagttgctgcgcaacactattataatcttcactagaaatcaatatgctctattcagtctaacgacagaaaattgacttggctataataataaattgaagggtcgccagtgatggcacctttcgccttacatatctaaaagctagctttctgaatcacaattaaaaggtcaccagaaatggtggccttttaatgtgcgcttttgattggcaaactgtgtttgcatgattcagttgttgcatatgattttcaaatcagcaatccgaactcagcaactatcttagttataacacctacatttggaaagattgagctttgataatttccatgcttccaaattcagcgtcttcattcaaataccagccatcgcgaaataactggctcaatcactcatctaagctaatctatctcccaaaatatctgatatctattaaatcaacaagtcagttggatactatacatcaatatctcggtaaccaactatttttagttaatctttaaattgaattttaacgtaatcccgatagagtgggacgttcgccatcagctcttgatgcgtacctgaaccactcacatgcccatcttcaatgaagtaaatctgatccgcatccacgattgtgctcagccgatgggcgatcactagggtcgtccggcccttcattaattcgccgagggcttgttgtaccatcgcctccgattcggaatccagactagcagtggcttcatcgagcattagaatcttggggtctcgtagaaaagcccgtgcaatggctaaccgttgccgttgaccaccactgactttaaccccacgttcgccaacttgcgtctcaaggccatctgccatggcgcgtacaaagtcagccgcggaagctaattctaagacgtgccacaactcattgtcggagtataaccgatcagcaccgtacgttaagttttgacgaatcgtgccagccatgattgccgagtcttgactgacatacccgatttgtgaccgccaactattgagacttagttcattaacatcttgctcgccaatactaatttcaccagcggttggttgataataacgttccagaaggccaaagatagtcgacttaccaccaccagacggtcccgcaaacgccaccaccgtatttggtttagcttcaaaactgacatcgtgtaaaatttgttgatcatcatcataggcaaagtcaacatggtgcatcgccaaagtctcattggcgactgcgtgttcaacaccaaccgtcaattgttcttctggttcattcaacaactcccgaatccgggccgtcgagccactggcctttgctaacgtggtgaagaactgaccaagcatcccagctgggccaatgatttggaacagatacattaaaaatgagaccaaagtccccatcgtcatcgttccactggcaacccgcgcagacgcatacaatagtaccccaacgaataacgccatcatcgttgccgtcatcactggacttgagatggaatcataaatggcttcgcgtagtccaattcgatacaacgtcttaatctgatgtgcaccagtcgttgtttccactggttcagcattggacgatttcactaagcgaatctcactcagcgtttcttctgccgtcccgctaaaattagctaaagcatcttggcgttcatgaccaatcttgcccgtctgccgcatgattggaaacatgactaataaaacggctggaatcgccaagaccataatcaaggtcattcgccagtccatcaagaccatgattgcgatggccccaactagttgcatcagcgacgtcacaacttgcggaaatgcgttagcgagcaagtctttgatctgcgtcgaatcattcaccaaccgcgacgtcatttcacccgtcttaacgttgtcaaagtagcgaaccgggagccggactaatttatgccataaagtcccccgtaaattagcgacaacattttcaccaaaaatccccaataaggaacctgataacgcgctaatgactgcactgatcaagaataagccaatcacaccaattagtaaggtctgattaacgccgtgactaaacccattaatcaacgtttgggcaaacttgggcaccatcaactgcgcaccagtcgccaataagcctaatgccaagcccaaccagagttgccaataacgagggctagcgtgccgaatcaactgtaagaattgttttaaatcaaatttaccacccgccggacgcgagtatgctgcttgtggtcgttccatctgctcttatgcctcgtgtttctaaaatttaattaaaccaatgatgcccatgaccccaaccgggacgtgggccaaaaccgtgttgttgaccaaattgcattaaatcttgaatatcgatgtcatccgcattggcccgcaacttatctaataaatgttgtaactgatcgcgctcatcatccgtcagattaccaaataactgatccgctaaatcactcgttccttgcgcgcgatggtccgccatctcacgaccacggtcacttaaccggacgatcaccacccgtttgtcatgcgcacttggttcgcgttcaatcaagcccccgtcttctaaccgattcaacgtggcactaactgaacttggtcgaatatccaagatctcagcaatctcagcattggttaaaccagcgggtgcatccgccaatacccgtaaaattcccatttgaccacgctcagaaccatggtctccaaaatgaaattgttgggcaaccgccatgacgaaggcccgattttgaaataacttcccaaaactactaaataaatcacgattattaactgtcatgaatttttgtcctccttgatttgaatgatgcttatgttagcactatagttagataaatgcaacaaaagctaactaattatataaacatttttttacctgtccaattgcgacttcaccgcaactatcattaacgatattgcttttacctcaattatcaagactacgatttgcacgataacttaaaagtccgctctttctgaccagcagttctcagaaagagcggacttattactattcaatttagtgtaattaattattaatgatgagttcggccggcaaagcaatactttgcggatgttcactgattgctaattctaatgcccgagctcccacgacttcaaaatgatgatcaatggttggaatgcccaacacttcaccagacaactgatgctcctgcccaatcaaaagtggaacaggccgttgcgcagccaaataagctcgacgcatccccactgcaatgtcatcaccattagtcagtaccgcggtcactggttcagtaagttgggcaaaataggttccagcatgctcgccatcttccgccgtaatgattccggtatacaataacttcggtgacaatgtccgctgataaacttgttcataggccccaaccatcgcctgtgtcgtggcactaacctccagcggtcgacttgttaatatcgcgattcgctgatgatgtcgctgttttaaatacgtaaacgcctcaacatacgtcgctgtacgctgggcataggcagctggtaaagaatagtcatggggattttcacacaatacgattcgtccgtaacgctgataaactgcaagtttttttaatggcaacccgtgggatgtaaaaatcagtgcatcataagcatgctgacggagtgcctccaagtatttcaactctaattgcgagtcccatttggatggtagtaatacaatgtgataattcgcagcaaaagcagctcgcataattccatgtaacagttgagtaaagtatggatgatcaacatgcggcagcacaactccaatagttaacgttgccccccgactcaggttacgagctacggcgtttggaacataatctaatttgttgattaccgcttcaatatctccacgagttttggcagaaacataattttgatgattcagtacgcgcgaaacggtggaaactgaataaccagacaaacgggcaatatcatgaatgttcgtcatcaatattacctcccgattaaatgtgacaaggcgtaagccacgccatcttcatcattacgtttggtcacacgatgcccatattgctgaatagttgaatcagcattgcccattacaattggtaaaccaaccgccctcagcattggcaaatcgttttcaccatcaccaaaggcagctatctcattagttgttaaatgatatcgttctttaataaatgcaattccacgagacttttgtgcctgagcactagttacttctaaatacgtctgtccagataatttaacactagcgtaactaccgaccaattgtttaagggccattgcgagtgttgccataacatgtttgtctaaggtcataatcataattttaaaaatagctgcaggatattgccgaaagtgatctgtataactcgtaatcggtgttactatttgtcccgtcagctgctgttctgtacgagtcccagcatcaactttttccgtcacccaatccgtttgcgtgtaacagctcaggctaactgtcggcgactccgtcttaacaaactcgagcacttgtaatgctaatttctgatctaacggggctgcttgtaacgccttaacttgattctgacaatattcaaaaatcaaaccaccattaaagccaatctggggacctgttaaccctagtgcctgaattgtatcacgcatttcaataggtgcgcgagctgatacaagcgtcattggtaagccactttctcgcactgcttgaacagtttgtggactcacaattccttgagaattcaatagcgtcccatctaaatctgaaaacaaataattaatcatgccaatgtactcccgtcaattattttattaatcttacccttagtatacctgctcaaacgcgttcgagaacaagcccgatgacaaaaaaactcgcgatattttcgcgagttaaaaaggttagctcaattaaatgaattcggtaacctgcgtaccagcgtaacgcgttgtcgtgatcggttcgctagccgccttgccaagtgctatagccatcactggtacatagcgcttggcatccaagccaaaggtcgtcgcgactttatctgccgcataacccgcaattggattagcatcatagccatgtgcgcgggcaatcaatagtaattgcattgcggccatactactatcaatcatcgcatcggcttgtagaaattctggactcgcattttcatacattggtaagaacgtcttgaagatttgatcccgcttttccggggtaatgcgtccttcttcacaagctttattccacacgtcccgatagaccaaatgcgattgcgtatcgcctaggacaaaaatcatggctgagcaagaatcaatttgtggataattaaacggcattaaaaccgactttgctttcgccttaccgtccgcactatcggcaaccacaaagtgccaggattgcaagttgcatgctgatggtgcactgattgtctcatcaataatcgtttgcaattcttcacggtcaattttgacagtcggatcaaactgccgtactgattggcggttaaacaccacgtctttaaaatcattatttttaatattagtcgtcatggttgttggcatcctaaacaactccttttttaaaagtaacaaattcattaatcaatcttattataactgattttgtatttgttttcacaattattttgaaatcgctatcattagcacctattattccgaccaatatttattttttatgctcattacctggggtcatcgtttataccagtattacttatgcttgtcggacttgtagttccgtatttgtatttatattagaccactcccaattgtactgttaatcttattaaaccaatggactataccaataaaaagcggttgtaatagcgctttcaccaccgtacaacaatggttgcacttattcaaaactatctttttagggggattttgtacatgaagaattatttgcaacgtatgggccgttcactgcaattacccgttgccgttctacccgcagcagctttacttgtgggaattggtaactggtgggcatctgctagtaacgacatcgtcgcacacttcttacaagccggtggtaacgctgttctgagccaattaccactactatttgcagttggtttggcactcggtatgtcaaaagataaagatggcgcagccgctcttgctggtttagttgcctttgaattaccaactaacgttttaaaaccagaatcggtcgccacactcttgaatatcaaggtagccactgttaatccagcgtttggtcaaattggcaacgtcttcattgggatcatctctggtctgattgccgcagctctttacaatcgcttccacgagaccaaactaccgatggctctttcatttttcagtggtaaacgtctagtcccaatcttagccgcgctgaccatgttattagtcagcgttgcgcttctcattgtttggccgcccgtctatgatgcattagttacctttggcaaattcatcgtgggtctcggtgccgttggggccggtctctatggcttcttcaaccgcctattgattccaactgggttgcaccaagcactcaactccgttttctggtttgacgttgctggcatcaatgatattggtaaattcttagcacacaaggggatcaagggtgtgactgggatgtaccaagctggtttcttcccagtcatgatgtttggtttaccagctggggcctacgcgatttaccgcaatgcgttaccagaacgtaaagttgaaacagcatccctgatgatggccggtgcgtttgcgtccttctttaccggtgtgaccgaaccattagagttctcatttatgttcgtagcttggccactctatgttttacacgcaatcttcactggtttatcgctagcctttgctgccttcatgcactggacagccggttttgccttctccgccgggttagttgactacattttaagccttaaaaacccgattgctaatcaacctttaatgttaatcttacaaggattggttctagccgtcatttactactttggctttgacttcgcaatcaagaagttccatttgatgacaccgggccgcgaaccagtgacagccgatgatgccgatgatttagccatcgccactgatgcggatgatgacaaatacacacgtcaagccaagcaaatttacgctgcgctcggtggtgccgataatttaacggttgtcgataactgcacgacccgtctccgattgcaattagccgatacgtcaaccattaatgaagccgctatcaaacacagtggtgctgctggtattaacaaattagacgaccataatctacaaatcattattgggaccgaagtccaattcgtcgccgacgtgttgagccacttaaagctcacgaacgcacccattactaagaccacgactagcgatgaagctgttgcgacagcaccaactgcgactaatatcactagtggtgtgaccaccgacttttacagcgtcgctaacggtcagtacgtagatattgaaaacgtcgccgacaacacatttgctaagaagatgttgggcgatggcttcgcaattgatcccgcagacgggacgattacgacgccggtcgacgggacggtcagcaccgtctttcctaccaagcatgcaatcggttttaaaaccgattcagggttagaaattctgctgcatatgggtattgataccgttgagttgaacggtgctccctttgaagtactagtccaaaccggtcaacccgttcaccatggcgaagtagttgccaaagctgacctggcagcgattaaggctgctggtaaggccacaaccatgatggttatcatcactaacatggatgctgtcaatttgatgaaattcaagatgttgaccaaccaagtcaaagtcagtgatgagattatgttggtcacgacgaaataacttgttacatgcgccaattatatgaatagccccctacgtatttgatacgcagagggctattttcgataatctagtcgccggacaattctttaaatttcccttaacgtaactcattcgccatttagcaacgtttaccggcaattatggattattcaattaacttatttttccagaattatacgtcatatgaatattatcgccacgaaactaatatggtatgctaaaacgattgtcacctagcctcggaagtcggacgaacacgtgttgatgaactgcaatctaaactaacagcacgccttaatcatgatttgcacgaagcggtgactaaccgaacctacaataattatattttggtattgctcagcatgcgctaagctagaaaggaaaaccaatgtattttggcgatttaattttcattatatctatcatcggtggtctcatcagtttaggactgatcatttatttgattgcgaaattcgttaagtaagataatgacctgctaactgatcatcggccgttgcaagtcgttttttgcaacgacagcctcacacctcagctgcgaacatcgtcaccaagtcatccgtccgcaatgcttgcttttcggcaccacgcacgtccaacttgatctgaccatcctgtaccatcactagccggtcgccgtatgtcaacgcatcgctcattttgtgcgtaatcatcatcgttgtcagatgattggccgtcacgatttgttgggtcagcgccatcacttccgcactcgtcttcgggtcaagcgccgccgtatgctcatccagcaacaacagctctggttggctcaaggtggccatcagtaaggataaggcttgccgttgccccccggataaatacttcacttgcgtattcagtcgcgcttctaaccccatattaagactagccagcaaccttaagtatcgttcttcctgtccacgttggcgataacggcgcagactcaagctccccgtatgacgttgggctaacgtgagattctgggccacacttagttcgccagcggtacccaacttaggatcttggaacacccgggccacccaccgtgaccgatacgcaacgggacgattggtcacacgatgattggctagtgtaatctctccagcatccgtatttaacgttcctgcaatcgtattgagcaaggtcgacttgccggcgccgttgttcccaataaccgccacaaattcgccaggttcaatcgttagattcacgtcctttaagacgtgccgctcgttgctggttccgggaaagaagactttttgcaagtgttggacgttcagaatagttggttgtggcatgttgatcgactccaatctctttaaggtaccggcgtaactgccgttttgtccggtatttattttgtaatagtggcaagcagatgacgatgacaagaatcgccgctgataaaatctttaagtcattgacggggaaacctaagcccattgccaaagtcaacaaataacgatagataatggcgcccacgaccattccagtcaaacggacccagatttgacgaccatgtaagaagatttcaccaaccaggactgaagccagcccgatgacaatcgtcccaattcccatcccaatatccgcgtaaccgttactctgtgcaatcagaccacccgataaagcaatcaaaccgttagataacatatagccaataatgaccatccgatcggtatagattccattcgcagcactcatcgcaggattattacccgttgccatcaaagatagtcccaaacgcgtctggaataaccaaatcaacccggccaggacgaccagcgtaaccacagacccaatcacgatggtttgtaaattcaaagaccagctcgctggtaaccatcccatcaacgttttctggtcaagcaagggaatattcgctttgcccataatgtgcatgttgatggaatatagtcccgtcatcgtcagaattccggccaataatgacggcattttaagcttagtatctaatacccccgtgacccaaccggccaaacatccggcgacaaatcctaataaactcgccacgatagctgactgtccggccaacatgctactaatcgtcacggcagcccctaatggaaaactaccctcggtggtcaaatcagggatgtttaaaattctgaaagtgaggaacaccccgataaccagtggcgcccataataaaccttgtccaatactcgtgattaacatattacctcgctcccctcttatggttgcttgattgtacttggttgtaagccgattgccttagcattcgctttattgacgtagaggtgtaacttgtcagctgtttgaaccgccattgtttgcggcttttgcttcttgattaagacttggtaagccatttttccagtctgttcacctaattcgtaatagttaagaccatacgtcgcagtcccgccatcttcagccatttcaatcgaacccgttaccactggtagctttgcagccttggtcttctgaccaatcgtcttcatcgcactcgccatcaaattatcggttggtaagtaaaggccagatattttacccgtcaaaccggccaaaacactggcaacgtcattagtactcgttgcgctaacgacctttaagttgataccgtgctttttcgcgtaagccttcgccaacttgacttgtagcactgaattttcttctgacgagttatacataatccccaacggtttataacctgtactcatattcttcaataactgtgattgtttgccgacgggcattaaatcgctcgtgccgctcacattagtttggggcttcgtatcacttttcaccaaccccgccgctttcaaatcggttacggccgtaaccaaggtcggcaccgtcgtcgttttcttggctaatgcctgagcagctggcgttgcgatgccaactaacaaatcatttttctgttggacgagttgttggctcattgtattcaaattactctgatcaccctgtgcatttagatagtgatacttgaccgttattttactgttatgcgcttttaattctttttgtaatccggctttgaagcccttgcgcgcttggtctagtgaaccatgttgaaccacctgtaagatgcccaccgacacgctttgctgaccactcgttgcttgtttgccacaaccagctaatagtaacccagcacctaaaattaatacccctaaagttgtttttttcatcttgaaacgctccttaaaaattgtctggttcgcccaacgttcatcaacgtcttgatgaaccggattgaaaacaaaaaacaccagttagattctgggaagaatctaactggtgttttatcgggcccgatatttttccagatagattgtccctgcatctacctggcgtttaagtcatgttgaataactttagctctcgatagatacaaacgcgttgcgtgcgcttgtatccatcaaacgaatacaaacgctatctaaagaaaaagctaaaggcaaattgattatttaattgaaggttagttgctaatgacatattagtcatcctccgtttcaatttatagctaatagtaaaccatgacgacacctaacttgtcaactgcgaaccagtaaaaaatttaagtgcaattggtcaaagtccccgtcacccaaatgatacacgctaacttatttatctggcgtatcactcagagtccaactcaaggtaccttgataagtatcagcgtaaatacctggttgcgctgataatccgattcccttcgttgtcgaccaatcgtcagtgactaccgtatcggtcgtccccgcgactttttgtccctgttggaccaacgtcgcttgattcgttaagacggtctgtgcactaccatcacggtaaaccaaatcgcccttcaacgtccgtccactgaccgttgtcgatgtcagcggcgtggcactaacgtacaaataccacttagccccggtcgcccgggtatcagtcacactgatggctagtggattagtcggttgatagacttgtggtgtcaacggcacctttaaatcgccgaagctcatattggtcgttaattgaccaaacgacagcgtccctgctaacttagttacttgtagcgcaattttatcagatgttaagccgctggcgctcgtcgcatagatgtggaccgtggtactctgattatcagcgagccccttgaataacgcgaccagaccgctctcacttgcatgataagtcatcgtgtcattagcgttactaggattcgtcgcaaccacgccagcctgcttaactaaccaattaacagcatcgctatcagacgtcaacgccgctagatcactcacggacaaattcaccgctgtactgctacttttgattgtcagcggtggtatcgtcacgtccttagtcaccgattcggattcgccataatcggcttctcccgtctgcgttactgtgactgaagtgaccccactgaggccatcatttaacttaatttcatatttgccatcactaccgattgtcgccgtgtacgacttaccattaattgtcgtgctgacggtattaccggcaatcccagttcctgtcagagtggtatccgtcgttgttggcgtattcagcgtcgtattaaggctaatccgattaaacactgccaagcggtacgtggatgtctcaccctttactgtagttaatcgaaacccaatatatactggcaaattatcctttaacttactcatatcgactgtcaaagtcttgctagtattcatcgataccgtactagaaccagtcgccatatttgtcggagtcttggtcactagtgaagttccaaattcttcggttgcttgcttataaaagacatcgtaatatagcgttttaatctccgaactattcgcaaacaacgaaccactaaaggtcaacgttattgtggtagtcttagtcgatatacgtccctgatccgcatagttggccgtcactttggttaagcttggatatatcccaattccacccgagatattgaacccaacgacatcaccgctattaaagtaagtgtagtacttattactcgaattagcgattgtcgttgtcgcagacgtcacgggcgccgctgcctgactcgtaatcgctagcatgctgataaacgctaagcagctcagtaacagcatgcctagcttaatatgccgcagtcgtttcacgtgttcgcccccctttcacgcattaacttaagcacctgccaccctaataagagtgccattaaggtcaggaacccgagccactgataatagtgattcgcttggaccccggtttggggcaaacggcccgttgctagtacctgttgccactgaccgacaaagcgattgggcgtggctttgacagccttcgttgcgtacacaacgtcgccctgcggaatttgttgcaccgtcgtaggcgtttgtttgtccgctgaacgtgacgtatagaactgtatttgtgtcgacgaagtgcccaccgtctgagcagctcccccgatggatggtcctaggccgattaataagcccagtaagccccgtatcaacagccatcgtatcatttgtcagtcccccttttttacccagctactaattgttcatgacgcttagcagtcccaaactaaacaccgagccgattgctgttaatcttgggattgccgccgcttcttcaagaaaagcactaaccacaaaatcagtaagactacaatcaacatgcccagtgcgcccagaccaatcaaccaccagatactgatgccgttatcatcaaccgtatcctggttatacgtcttagccgtggcggcactaatcttgaagtcgcggtcaaaagtccacttatgagcgctgttgtgcgcaaccaagtgtaaatgatacgtccccgcttgaagcttctgtttgttgagtaacaatgggtaattaaacgtcgtattaggcgccaacatcacgccttgtttggtcgcctttacgacggttttgccactatctttggctgtgaccgtcgtcttcatggtaacccgtggtatcatcactgctgcagtattgcgtaacgtcaccacgatactccggtgataattaaccattccagcagcgatatcgcttagtttcaagacgggcgtgggcgcagtccctaagctgtacttgatgcccaccacataagaatattcactgctaatattcgtagcacccttcacttcaccagtgaccttttgatcgacgcgtttaaaataccaaccacctaacagggcaccgttaaaatccttagtcggcatggtcgtttgggcactgaccagcttagaaccgttggctggaactgtcaccgtcgttggccccttgattttagtcaattggtcgacccgatactgcagtgaggcatcatactttttcgccggggtcacgtattcaattgcgccgccactgttggtatatgccgtatgaatccccattgcaacgcggatatcccggttagtcgtattatagattcgcgtctgcaacgtttgggtctgccctgccgtcattttgaggtcaaaaaacgttgcctgtttatcaatttggtttttcggcgtttgggccgcgacactaaaaccaatattattactggtgtccgtattggctgcctgtgctggaaccaccgcggacaagccgctgatcatcactaagatggcccctaaccaccgcatcattttcttcattattgcgtccccccgtcgattattatgtaaaagagacgcccactattacgtggtcatctccaagttcattaatttaattatctgctgatgatgttaatgtccaatttaggacgcccttgtaagtcgtagcggccgccgtgttagccacgacgttcaacttgactgcagccggatcaagcaagtcagacgtaatccccgccccactcttatccgctgctgtcatgacattcccagaagttgtccccgtaaaggacgccccggcactagttgaagcttgactacctaagtcaagttcaacagcttgtccgaccgcaccattaccaccggtactgccgttgctagcttccgatccggaagaaatgaccgtccctgcaggtaaggagaccgtggcccccttaagcgtacttaagttaccatccgtgccatccgcagcggcaacactcaatgtccaacccgcattcgtcccgcgttgatcagagacttgtaaaccaactttacccgttgaccccatggtgaccgtgctaccatcgctaccagtcaatgctttatagctttggttattgatcacgtcaatttcatgcgaaccgaaatcaagtttaccgggcgcatagatcagtgacaaaccagcaccggaattggcaccgttatcgccatcaccaggcttagggtcaagtggtttcgttgggtcagtcggatcgaccggatcaactggattagtggtatttgccgtaaacgttgccgttgcattcgtcgtcccactccgattttcaccatcggccgcgtgaccaacgattggcgttaaggcccccaataaaatggtactggtcatgagtaaactgcctactacttttttcatatcgtgcatcccctttagtttgcctaattcattaactgcactaataatttaccacacttcccaacaattacaaccccttaatctttgagttgcttctttgttaacccgtgaaaatcaaccaggtcaactgttccggccgtattttgtatgcagtattaattttttgtttcatcatttttacattaaaaaacgttctatccgctgtttttctaatacttgtacaacattaataaaacaacagatagggatttaatccaattaataataattttttttattgtgacgttcaggtcagtctcgttcttcttgatcagtctcggtttgctatcaattttattatccggtcttaaatttgtgtgtaccgctcaaaaccgcatggtaataacgaatccaatcagttatcactactcctcacaagtactagttagttgccgtaatttcccattagctagcgaatgtcctgtctataaaacattcagtcgaccgcagccttaagtaacaatacgtcgaaaaaaaagactcaggattgaatcatcctgaatcttttttgtgaccacacactttcaccacgccctataactttgtacaacgcgatgtctttagccacctaatctccaataatagacaatagccgccagagctaatcactgaccggttgtacttcaaaacctgctgctgtcaagacttggttaacatcggcggcctgttcactattcacgtggagctcaatcactttttcagcctggtgatttacgaccattaacgtctgaatacttaaatcgtgttctgttaagacctttccgatggcaaaaattacgccgacatggtcatgatggaccaccacccgagttacgattcccggctggccgtaaccagcaatatttaagaacgcatccaagatatcattattagtaatgatgcccacaacttggtcgcccgtcatgactggtagtacgccgatcttatttttccgcatcgttgcaatcgctgtttctaactgagcggttgctgcgacagtttgaaccgccgtttccatgatttgatccaccgtcgtcttagtaagtaagtaagtaatttaattcatacaccgacaaactcgtggcctgtgatggcatcgcacgctgaatgagaccatgcgtgatcaagccgaccattcgattacctgccatgacgggtaaccgatgaatcgcatttttcttcattaattcgaccgccacactgatcgtcgttttaggactaacaacgaccaggcgtggtgtcatataatctgcaacactcatacttaaccccctagataagctttctgaacttctgaattagctaataattcggaaccccgaccactaagcttgacttgtccactagctaagacatagccgcggtcagcgattttcagggcttgattggcattttgttcaattagtaaaaccgtcgttccagcctgattgattgccttgatgatctcaaagatctcattaataaagatgggcgctaatcccattgaaggttcgtcaagcaacatcagcttgggctgcgccatcagtgcgcggcccatcgccaacatttgttgttcaccacctgagagcgtcgcggcatcttgatgccgacgtttcttcaaaattggaaagtagtcgtaaacttgctgataagtctgagccaattgaccccgatcctgccgtaaaaaagcacccatttgtagattttcttgaacagacaggccgggaaaaatatggcgtccttcaggaacttgcgagatacccgcccgcacaattttaggagcggccgtcttttggatgggttgatccaaatagtgaatagaaccactgaccggacgcatcaagccagatatcgtgtgcaacaacgtagatttcccggcgccgttagcaccaatcaacgtaacgatttcaccctgttgcacgtcaaaactaacacctttgactgcctgaatcgcgccgtaattaacgactaaatcacgtactttaagcatttacacccctcctagataggccttgataacggccggatcatgttgaatggcttttggcgtcccagttgccagtaacgccccgtgctccaacacgtagagccgctcgactacgttcataactagtgacatgtcgtgttcaattagcacaacggtaatatgaaattcttgttgaattcggcgaatcaagcgcgtcaaatccgccgtttcttcgggattcatacccgctgcgggttcatcaaggaagagtaacttgggcttcgtcgccagggcccgcacaatctctaatcgccgctgaataccatatggtaaactctttgcgggctgatcagcgacggcggtcaaatcaaacatcgctaataaggcttgcgccgcctgggtcattgcccgctcagtctggtaatacttaggtaagcgcaggatgctagtcaaaaaccgttcatgataatgattggtcattgcaatgcgcacgttatcgagtacactcatctccttgaacaaccggatattctgaaatgtccgtgaaataccaacccgagcaatcgtagcgggctgcttgccatttaacgacaccacgccctgatctgtgtagaaactaatgctacccgaactaaccggcgtttcaccagtcaacaagttgaataacgtggttttaccagcaccattcgggccaatcaaaccaatcagctcgtcttgatcaaaatggagtgaaacgtcagcaacggcggtcaggccgccaaagtttttgaccaacccttgtgcgtctaataaccggctactcatggttaaccgcctccttagttgatcgccgtctgaatagacgcgtgaatgagaactcccacgttcctaacagtccggctggcttaaaaatcataatcaaaatcagtgccaatgaataaataatcattcggatcgtaccgaagttttgtaagatcgtgtcgagcgctcctaatacgattgcggctacgaaagtcccggtaatactgccgaccccaccgagtacgacaataatcagaatcgcaatggaagccatgatattaaaatcacccggcgcaatcgtctgaatgtaggccgcgtgcaacgacccaccaatcgccgcagtcgccgcgccaaagacgaaagcggccaacttccagcgcgtcgtattgattcccatggcaccagccgccagttcatcatcccgcacagccatcacggcccgaccaccgcgactgtgaataaagttgaccgtgataatcgttgtcagacacattaagacatacaccgttgcccacgaagcaagtgccgggatattgaataaccccgctgcaccgttcgtaattttcagattattgattagaatccgaatgatttcggccgcccccatcgtcgcaatggctaagtaatcaccgcgcaatcgtaatgttgggatgccaacaatgaccgccgctaccatggcaatcaccatgccgacgatcatcgacagataaaatcccgcgggcgtcgccattgtttgggtcataataccagtcgcgtaggcgccaattgccataaagccggcgtgaccaagcgagaactggcctgcaaacccaataatcagattgagtcccaccgccaatataacgttgataccaatcgtcaccagcatattttcaataaacgagttaatgacgcccatcagctctaaaccgtcaatcacaacaaagccgataaccatcacaccgagccacgccatgttagttttcaaatttgctttcattaatttggcgcctccctcagactttttccttggttcgtttaccgaatattccagccggcaacacgagcaaaataacaattaagacaaagtaaaccaccgcgtccttgtatgcggataggccaatcgcctgaacaccagtctccaggatgccgataataaagccccccaatgaagccccaggcacagaaccaatcccaccaatcacggctgcgacaaaggccttgataccgggcgtcatgcccatcaacggatcaatcgaattatagtataggccaatcaagactccggcagcgccggccattgcagaccctaatgcgaacgtgaacgaaatcgtatggttaagattgatgcccaccaactgtgcagcttcgggatcaacagaaacggcccgcattgctttacccattttggtacgtttgataattaattccaatagaatcattaataggcacgccgttcctaagatcagtagctgcacattcgatacccgcaatccgccccagtgataagtcaccactttgattgcttggggaaatgaacgggcactcgcaccaacaaagtatgacattccattctcaagcaagaatgaaacaccgattgccgtgattagcgcggtaattcgcggtgaatggcgtaatgggcggtacgcgaaatattcaataatcacaccactaactgcacagatcaccattgcggacaggagcgccgcaacaaagttaaagtgtagtgacttcaaactgtaatagccccaaaaggcccccaacatataaatatcgccatgtgcaaaattaattaatttgataatgccataaaccatcgtgtagcctagcgccaataacgcgtagatacttcctagcgatagtccgttgatcaattgttgtccaaatgtctgtatatgtgttcccccacgctttcactagtctgactatttgacgttataaaccttgctgaccacgccattcgtcaattgttcaattgaaatcgtcttttcaggattatgttgcttatcgatagtcgtcgtcccagtgacacccttgaagttcttaagtttggctaaaccatcggcgattttaacagaattagccgagccttccttttcgatggctgctttgatcatataaaccgaatcataagcgagtgctgaaaaagttggtgcggtactaccatactttgccttgtaagcactcataaatttcgaagcaactttgttcgttgccgaagccttagtagaaaatggcgtcgtgtaataaacattggtagcattagacttgccagcaatttgggctaatttagcatccgccatcccgtcactaccaacgattggagccttgattcccgcttgccgcgcttgcttaacgattagaccgatttctgaatagtaaccaggcgcatatatggcatcgatctttttatgtttcaacgcagttaggatggcattaaagtccttatcgccctcttggaacgtttggctgctaacgaccgtgccccgatactgcttcttaaacgcctttgttaggcccgtgccgtaatcactggagttatcagtcaaaatggcgacgcgtttcgccttcaagttcttagtcacaaaggttgctgccgtggctccttgaaaattattctgatagcaagctcggaatatgtacttttgaactttgccactcttttgcaacgtataatccggatcggtcgctgatggactgactgatggtactgccgccttagtcatattagggatcgccgcagtcccggcgctagttgtcgcgggaccaactacggccacgaccttatcgttattcacgagctgggcagccacggaagcagcagtcgtgttcgatgtcttattgtcccggatcaccaactgaattttcttcttggtccccccaaccttgattccaccgctcttattgattttcttgacggctaactgaatgccttgcttttgctgttctccataaccggccgcagatccagacaattccatattgaccccaattttaatagtcttgccaggattatttccttgacttgaacttgatttggcagtggcacaccctgccagtgtcaacgccatcgcaccaagtgctgcaatcttcatcgtttgtttttcccattttttcattagttattcccactttcgtttttttattgctacgttgttgaccccgatcctccttaagtcacaaaaaggcctcatccaccgtagtgaatgaggcctttacccggaactgagcctcattaccacaatgggaaagaagggctcagttcacttgaattttgagttatactcaaggtcaagtgaccgggtccttcttcgttaataataaggctaaattttgaacagcaagggttgtcaacaagttggttaggttagattgaattttcataattgacgcgcctcgctttcaaaagtttttgtaatgttgatgtttcttagattaattaacttttaattataagtcaagtgaatttttaattgtttttatattaattaaaaggtaaaccactacgggctcatagtgtcgacagtaattcaaaaaaattatttttggtcttgattagcttcggttgagaggcccccctgaccaaccagcttattcagccggattaaaagcataaaaaaagaactgattactaaactggcaatcagttcccattcaaaaattaggccgtcatggtcgttattctagttaagcctttaagagtttttcaacttcgctcttgagcttagcttcgtccatactcatataaggcgctacttcgtcagccgtcttgtcagtatcatgactatcagcgtccataaagtgattccaaatcgcatcccgtacgggtaacttagagtcgctccaatcaaacacgtccgtcatcttttcgtctaacatactgttcatttcaactgctgcagccatactaaaacaacttcctttctaatttttgatacaccttgattataggtcaaaatttgaaaagtggttaaattttgtttggtattaggtagattgtaaaattaatcnnnnnnnnnnttaaatttgcaatctaccattacgaaaataaattacgcattcttttgataaattgtttccagggccgcaatatcagcacttgacaacgtgctcttaccttgtgaaaccgggtacatcacggattcagtcgatgaactgtgatccaaccctaacgcatgacctaactcatgaactgcgaccgatttactgaaagctgaggcgtatgagccgttaagactagccgtcgcgttattccaatattggatacctcgccagctaatttgcttagtaatatcagggccaccatgaccaagttcaacactggtcgtaccagtcgtcatttttttatgatacatcgaaaaagtcactgaattttgtgacccgctggcttgaccagctaccagatggaccaacccagtctggttataagtcgcgacagcttcaagaaagacctgccgggccgctttgggaacattatgatcgaaggaataataatacgtcttctttaaggtggcgttctgcacgatcgattcaatcggtgttgcttgcgttgttgaactagttgcttgcgaactcgagctagtgaccgaactggcactcgcagtcttatccgtctgctgacctgatgattgcttacttgagttagtcgccgaatcttcggtagcactgctagtatcatcagcacccaacaaatgactagataagtcacccgacaaggcagccgctagattctgacgactcgtctgatataaagctgccgcgcgcggggcaagcgtatcatagttgcgccacccaaataacacgaggccgattagacacagcgctttgattccgcgcattagattttttagcatgctgtgcgctcctcttaattttttaacatggtgacaagcaataatttaagtttattaaaccacatgacaccccacttaaacatagctcttagtgaatcattaagaatatttaggattaccgcaatctacttgtaatcttaatccgctttcacacacctactcgtcattctaacaaccgcggcaccccactgaacaaaaaaagacgtgaattttcattcccgtcttgatgtggctacttatttcgaaaaacatacagtttcgagaacaagaagttcccaatgatggcgccggcctgcccaagaatcttggctagtaccgccgagctccccaatactgacatcaacaaccataaaataatcgcttcaacgacgtacgtcacgatccgggtcgcatagaacttacccatttcacgataaacgtggtgtgaatgatggtcgaacactttcaagcggtccacccagaacgcgacttgaacggcaatgacccaggaaataacattagcgacctggtattcgagtccgattaggtggtacatcgtatagaaagttgcaaagttgaccgcaacactgatcaatccccacaagatatagcgaatcgcctgattacgggtttctttaacgggtgaaataatttttttatctaattctgctgctggctctaaaatttcagtaaccgtttcctcattttgatcaactttaatcgaatctggcttactcatggttactacacctgactttcttcacttaaacatgattattgtgaaagaattctgtttaagttgtatcttcatttttatgagtaaaaataacacaacttaatcttagcacagcagttaactattggcgatggcaactattcagttttaccccaataattcacatacacaaaacgccaaccagctttaactgtccgcatcagctaattctgcagctagttggcatcatcatggggccgttgcacatcaacgaataaccaaaatctgcgacaatcatgaattaaaaacggcttgccgtagccgataactcatcattatcataggtgccaaaatgaccgttgagcgtgactcgatcgctactaaatagtggtcgcagcacttaataacaccatccacaacctgaacacctaatctgaagtctttctcgcccgattgagcggaatttcaatcgccatcacggccgccgctgtccaaataaagagatgcaagaagtcaccaactaattttccgctcacattccccgctaaatatgcaccagcatgttgatttaagaactgggttgatgggatctgactagctagttgtggccacaccaacgcgatatttaaaaccgccaacatcgtaataacccccactaattgccacgcctggcgtttagtggttgcccaatcatcaaaataattataattcataatcaacgtcgtggtcatcacaatcaatccaccattaatgaccatcgtcacgatgccgtcgttccaatgcaaaaaatagtgcaaatagcttaaaaatagtaggccaacgactaagtcataactgattgccaccaagcgctgttgccgccgattatttgccgactgagcctcgtagtgttttaacatccctaaatctcccttcaatagttgatcgactgaaaaatcatacgccgtactaatttgcaccaacatgccaatatctggatagcttcgaccattctcccagcttgaaatcgtctgtcgtgaaacgtgcaattgcgtcgcgatgtcagtttgagtcatcttcttttgttgccgaataatttttaaattatctgaaaaattcattttcacacctccaagcacatcgtacgcgacgggtgattgttcggcaagataagtttctaagcaagtcgatgaagccggcgatttgcgcgtgttgtattttttgagaatcgcgaaccaaaacgctacgacaatgatttccgtcatagcgttttagtctgcttggttgactgcttagtaagttaaaaatattattatcaattagaatgttttatatcaaactgttttaattattttgtaggcatacctaaaaaagtatttccatttacttttatttattgtacaatgacaacggctcaaagatttagagatatagaaaggtggtcttttaattgagcgaaaagacgaacaccccaaaccggaagcataaattgattgaatatgctaacggcccttcaccgctaccgctatttatgttgacagcccgcatgcgcggcgtgtctatcagctagacttagctgacgacacggtcgagatctttcaggccgatccaggctcagaactgtctgaacatttcttaccatataagacagttacactgaccacaactcaaatcaatcaattcaagcatacccagccagttgcatcataacggctacgggcaaagcggcgggcacaccctcttagtcaatgattaagaaggcgggcccgccgcttataatttcaattattaatgatccaaatcaactgctcgttgacgatcatggtggatcaaccacaacaatcccaataagagcaccaagagtccaaccaacatcaacgcattcttgaagtgcgctttaatcagttcatcgccaccccaagcatagataatcgccgtgggcatgctgcccagtagcgttgctgcggctagctgccggggtgtcaccgccgtttcaatggccgctaaactaactaatgacgttggaataaacggtatcgtatacccaatcacgattcctaataaggggtgccgcatcttaccaatggccgtcacgagttttgacggctgttgatcacgtcgagccgttacccgtccgaaaaagcgttgtgcaatcaagttgcccagcgtaatgccaataatatttaacactgccccaagccctttgccgaaacagatgccagcaacgacactgatcgtcgccacgggggcacctggaataattgaaaagcaaatcaataagggaactactaataaaatatcaatcgcgcggtgccgtcgaacttgggccaccagtgctgattgatcaaatacccgatgctgaatgatctcccaagtaccatgatagcgatagatcaacagtccaattaatagtaatgctagcagtactgccccactgataagctgtcgtttcgttatcttaaccttcacaacttcctcccgtcattaatcatgatgcggttcatgtttaatttcatgagccacatgtccaatcatggcatcaaccatttccaaaatatggggatcgtctagacaatagtagacatgcttcccccgcttcgttttagataccaactgatactgaaacaaaattgctaactgatgcgagactaatggctgcgccaaatgaacatgttcaacgatttgcgtgacgtccgcttcatggtgttctaaaaaaattaggattttaatccgattaacattactcaatactttgtatattttagccgcctcagttaatagtggcccgctgacctccatgccaattcctccgttctcaccaatcataggaatgcgattaaatggctaattagcccactatcccagaaaacatataagccaatcaccacgtaacaaattttcatcaaccgttcaccatgagccgctatttgcttttgaacagccttgatttccgccacctggttaatgataagcacgacaagcatcgtcaatataccaataaatcctaaagtcatcacaaagtgtaccatgctttccccaacgagcacaggtaaaaagatcgataaattacaaccagcacatacggccaaataagtaactagtacgttaatcaccggcgacccaccagcccgatcggcggtatcatcatcatcgtcgtgaaacgcaagccaaatcggcagcacacccaagaatcctaataaccattctggcaaaaataaggtcagtgctttacccacaaagaagcttgccgttagtagaataagattgcccaacaaatagcccaacaagacctgccacaaccgatacttcttcaataaaaaaactaacatcaagaaaaaatccaaattgacactcaaaaacgttaacgctaaaaccccataatgcatcatttcacccacttttctttacgcgttgtgctagtatttagcatcaactgtgattaaaacgtgccaagtttagattgttgttcgtcagccggtgcgcgtcctaagccggaagcaacccactnnnnnnnnnngcaattggcagaaatgcctggaggtcggtgtaggacgaattaactaaacaagtttacgctgagtcgaactttcccagcggtccatagctggctgcttttgaacttaaaaactttgcacattttaatcacgattcatgacaaattggctcgcgcaatgtgtgttctatttagttgtcttcattatatgtcaatttcgacatatgtaaagcaaattagcatcaaaggccccacgcacaaaaaacggtaatgaatcccgttctgggcttcattaccgttttactaacagactattttagttaatgactcacaattacttaatcagcggcgagggcatcgattggattcaaccgagcggcgcgccaagctggtaagatggctgctaataaggcaatcaccagggcaatgataaaggtcgagataatattacttacctgaatctcaatcatattgtagctggcgatttggtagaggaccttattcaaggcagctccaataccataagcaattccagtagctagtagtgcactgatgaccccaatgatcaatgattcactcgtgaacaatcgccgaatatcacggcgactttcacccagcgcacgtaagattccgatttctttcttccgggcactgaccgacatgaacatggtcacaatgatcattaacgctgagactagtagggaaattccagcgattgccgccaaaatcgtggttgctaagttaacatacgtattgaccgtatcaagcatgctggcaatactggtggcacggtaaacccgtttgccatcaatctttagcttattaatctgcttggttacagcatcattatgctcccgcgaatcaactttcaccgcaactgaagttggctgcgtacttaaattctttgctgaccgcatatctttcatagtggcgtaggtcacggcgttcacaccacttccagtcgtgctgtccgtgatcccagcaaccgttaattgccgtttaaccgtgacacttttaccactcttattcgttgtctgaaaagccacagtcactttcttaccgaccaattgcttccaattcttagatgaccatttcttcgccacactactcttatcgacgacgatttcattcttaccagccacgtgaccagctttaataatcgacttccggttagaagccgtccacgttgttaacgatgaagcggtgtagtctttattaccaactgtaattgtcgcgttgcttgcactcaaaattggctgaacggtctgaacatgcgcaacttttttcagtttactcagttgggccgtactgaacgttggctgattggtcgtcgccacactcgcccccatggcagctgcctgctggttaccttcttggctgccgcctcgctgactttgactcgatttttgataccgactcactgtcacgacacggggattgaccatatcattgatttcctgattaatataccccttgaggccattacctaacccgttaaacaacatcactgcgaataaaccaatcgctgtcccaatgataataatcaagttccaagtccaagtatagcgtagatgtttaaacgccgtgttcagtggcacataccacggtaacttacgtgccgcaatctgttggcgattttcatcgaccggataagcgggtttcacccgctcgtcatccgtgattttaccatcagctaagcgcacgattcgagtacccgcattcgcaacatcctgcgaatgtgtcacacaaattacaagccgaccttccgccgcaatctgatccaaaattttcaaaacttccgtggtattttcagaatccaatgcgccagtcggttcatccgcgataataatctgcggatcactcgctaaagcccgggcaatcgcaactcgctgcttctggccaccagataattggttcgggtactttttaatttgatccgctaaccccacctgagttaacagttgcttagctcgttgctcacgttctgaccgatttaacttggtcatatctaacgagatcaggacattgtctaacacggacagatggttgatcaaattatatgattgataaatataaccgactgtttcacgccgatactgatccatctgtttctcttggtgatgatctaacgcggttccttgcaataacacttgtccctgaaattgccgatccaagccaccaatgatattcatcaacgttgacttaccaccgccagattcccctaaaatcgcaacgaattcacctcgttcaaaagttagattaatcccattcaagactgggaaagcttccttgcctaaataataggccttgtgaatatcttttaattctaagtagctcatcctcgctcaccctaccttactgtacgtcaatatcgtgtgccaactcccctttatttatatcaagggctttaactgtgactattagtcattaagtttaccaaaaaaacaactgtggaaaaaatcttataccttatttttattgaatcttatcatagcactttagttagactataacaacaaaaactaactattaggctaaataatttgaaattaattattaaggagtgacattacaacctggttcgctctggtacttcaaccgacatcaccaccgttgatcagcgtgcacaaaaggcagtttcgagaaacacaccgttcccagaaactgcctcatccgtgcttacttccaaaattatcgtgccaagttatatttacctaggcgcgtcgcttccgccaccaaaccgcgattgcaccagtcagcatgaggaacacaccgccggcgactgctagccagcgttgcaccgcttcacctgtctgtggtaaccagccgctaccatgatgacctgtcgaatgactgccatgattagtagttgcactcgagctagtttcaggcaataccgtgccactcgtcacccgatccgtgactgtacttgcatgcgaactagctgtaccggccgtcattgaagtgccattgtcgttggtgctcgttttgtctgcacctgatgtattaactgtcccactccccgtggtgctagtttcatgcttgtcgggtttgacagcagtcccgttgccattcggtttagttgtgctactaccatttttgtccggcttaacggtagtaccattgccacctggtttagtcgtgttgctaccattttcatccggtttaacggcagtaccattgccatctggtttagttgtcgtgctgccattttcatccggtttaacggcagtaccattgccatctggtttagttgtcgnnnnnnnnnnatctgggttagttgtcgtgctgccattttcatccggcttgaccgcagtaccattgccatctggtttagtcgtcgtgctgccgttttcgtcgggtttagccgtactcgtcagtggattatcattatccaaatccacaagcacttctgtaccgtcggcagtggcagccattgcttgacttaacatgatggtcttagccgcacgcgtcttacttggtacgagtttaatcgtcaccaggtcagtcacgggttggctggcactgactgttaatcttaattgaccattagcgaccgtctgccgtaaaatctgcacgccggttggaaccttaacgtcagcgacttcccgacctgctaagtccaattgcagatcaaatgccgtcagttgccggttttggttatgagtcaattgaacttttgcttcctgatcattgcgactgagctttaacgtttcaactgaacgtttcttcttcgataggtcagtctgcttaagaaaagccgatgagtcaaagacctgactgtcaaacatctgtggtgtctgtgggacttgcaaagcattcaggatgagcgcactgatatcagcattgcttccaccatgcaaacggcggccattatcgaccgtttcgccaccgaacgccatgaaaatactgcggttatattcatcccaaccaccatgattcttgccagaaccgccatgatcagcgttggcaatgactaacgtatcatgaatgtgaccggttgcttcaagcttatccattactcgcttgaacagcgcatcatattgcgcgtacttatcccagtaattgtcattgtaccagccgtgaccgtgtccctgaccgtccatataatcactttgcatgtagactaacccagtactttgaaattctggcgtgccgatatagttagccacatcatcaaaggatttcagcgaagctgactgtttagtagtcaccgcggcatctggttcaatgatgctattgacgattggtccccattctgagaaagccgcagcgccccgagttggattatcggcttgtaacatcttaaatactgatgggaacattgcttgtggtttgttaaagtctgcaaagtattcttgtcccatggtcgcgttagtcccttgatattccttaggtagcgtgtcccatggccgaccatgtaacatggaaatgtagttttgtgccgaaatcgctggtgaaacggcccgcgctgacgtactcattgcaaactgcttattgaataagtccatcgtatacgtattccgacgtttcttcatgatttctgggttggttgtccatacgggagtcttagttccttgctccgcaccttgtgcatagtacattcccttcggatcccaggggttcccaccaccatcagtcgttaaaacgaccacgtgtttataaggcttgatttcagctgcattggcggctgccactttatcggctgcgtttgccagggccacgtcaccaacaccaataatcccgtcaccgttataatctagcgcgtacttaccttgaatttcaacagtttgagctggccctagttcaatggttgtatctttagttagctgctcaaacttgatctgcgtctcaccagcggccttagctttcaaattaaggtgcgctaaccgcgtttgcgcatacattttaaattcagcttttgaaaggttcgccgtcgtagtcaggcgaatacggccaggcgcaatcagttggatctgcgtctttcccccttgtaagagacgttctgcaccgacatagtcaaacttagccgcatcatacacgacatccatggtgattggggcggcaccggtagctttgatttgccgggcgtgtacattaagaccataagtgtgcccactcgcaattcgcttcgggccaacgagcttcgtcgcaatcgtttggtcgactggtacgggtgcgaccggctgcttgccgacctgtgcttcaacgttcaattgacttacttgttgcgacgtcaatgtctgatcatacaagcgggcctgtctaatttgaccggtcatcattgactgaacgtgacttccaggaaccgcatcaccacccagcacaaagtctttggttccttgtgccagctttaaatcaccgggcatagccacttgttggactaactggccatccagatacaagctagccgtcttattcttatcgatcacaccaaccgcatgcacccactgccccttatgtaaggtgcctttaggagtcttatagccggaaccatcatgggcgaagaaaacgacttgattgttttgcaccccaagtcctaaaccaccaccctgttggctagaaaagatctcatgttcaccattggcatcggcggctggatcatatttaaagtacgcctcgatcgccatcccattctgtaactttgcaaactgctgatccgtgaaggtcgtgtaaaacgctgatttgccatccaagttcaacacttggtcgttaaattcagggtccttcgtcacggcaggctgcccatagatttgccactgcgtctgcccaattaaatcaaccaattgttgattttgaattgccaaactcaaggttgctgttggaacggccgggctggcaactggttcggcaacttgctcactcggagtcgccattggggttactgcagcgacggccggggtcaccgtcgttgttaagattgctgaacaaactaataaggtcgttaaaacacgcggctttatcattataaaattatcactccatcttttttatcgtaaaacaaactgcacttttaagaatagttaaggaatgtaaagtgtttagtcagatgtttgtaaagaaacgatattatttatgttgcgatactttactagccagaagcttgtcaacgaccccaatcaaaaaagctccccacgtcttgctgggaagcctgataagctaatctattcctgtcgcactaagccgtttgttgatagccatttgcaaccagctgatttctaaaccacgtctcaaacataaaaccataccaaatatcgcctagtaacccgatactcatgacaacttggtcactaaaaaacagctgcgtcaccatatttaacgacagcatgcctaagaatggcaccgccgttttcagtaagaaaaacggggttcgacaccgcacactgaacagcgcataaaaccacgtgaacaacagggcccacacgttaaagtgcccgtacacttgcttggtactggtctcgccattgatagtcttagtaaacgtcatatcatgtctagctcgcttgttaaagccaaaccattctgatggtgcaaagttcatgaaaaccctcctcgtatcctgttcaatcattataagagttaactcactaacttaccactaactatcacgcttgcatgccaaaaaatcgtcgtacctcattagcgtaattaaacttagcgttcagtttgcccaataagtcttggtcatgggtactcgtaaaaccagtccggcgaagatgttcatataagtctaaatatggtaattgttgttcacgcgcaacggtcaactcaaggctaatatcataatcaacttttcgaaaatccacactgattcgacccgcgtcatccaccgttaagattgcatagtgagcacgctgatcagccatgaacttagcgtatggactataaggttggcctgtcgccccgggattaataatgagctggccccgctgactcacccgcataatttgttggtgggtatggccgtaaacggccacatccgcatcaccagctaggtgatcaaaattagactggcgttcatccggatacaggtcgtgaccagtcgagcgttccggctgattatgggccagttgaaaagttaacccgttcacgaccatcgttgtcgcaatgggccgttgcactaattcagcgtaatgtgatttgctcagatgggtcaccagatacgcggtcaatcgtgcaaaataaatctgtgaaggatcatccagtcgcccgtttccagtcatgaccgcattaatcccctgttcccaattaccttgcaaccatactgacggcgcagtgtccgctaaggtctggtagagcttttcggcacccgggccgggtaagaatagatcaccgaggaaccaataatccgtcgcggcttgctgacgcgcatccgccaacacagcattaagcgccgtcaagtttccatgaatatctgccagcacagcaatccggtgttgcatttctcgacacttccttttgcacataatacttctagtatacgctggcaatttacacttgtcgcatgatctctgttaagccagcttattaattgaccataacaagcgcagatggtcgtcatcacaactatttgcatgtatgctaatagtaatatttagtctaattaataccttggaggaggcattcaacatgcaacaattaacaccattagccgcctattcagacttggcattcgattggtcaatcgttattaatgaaggggctgcgggactaacgaccattcgccagcatttagcagccacgcttagcgactgcctggccgcacacgtgaccatcctttgtcgacctgcgatgtttttcctgatcattcacgaccaccggcaaaaggttgcgattcccggtcatatttatcctggtacggaacaaccttatgaaatccaactagacggctggccggtaaataatagcaccgcttttatgacaattattcataagtatcactaagcacttgatactacttatctgtcgttaccacgccaatcatcgaaagtgctaatatattcagtgttaacaatgcgagcgcttccctccctatgttagaatatactaagaaccaatcaggggggaaatcaaattgcagattgataaacaacaagttggtaatcgtattcaccaacttcgaattgccgctggtttaagtatggccaaacttgcatctgcgattggcttggctggaaaaagcacaattaatgactgggaaaagggacgtacgctagctaacgcggaccgactcgctaaagtagctgcatactttgacgtatccactaattaccttttatacggtagtttgactgaatatgtcaccgctgtctttcaaaatggtggtctcaatcattcagaattcaatgtcctactatgggaatatgtggacctaactacgaccaatccgaacattctttctagtgacttgttcagttcggcctcacagactgaacagggcgtatccgacccaactaaaatcgcggcggccttaattacaccgactatcaataatgcgattcggcagattgttcctgaaatcgtccaacactaccaacaaacgacaacctacccagaacctcaagccgtcattcaggccggttgctatgtctttcgtcaccgaatacagattattcggcggacctttacgggtaaatacaaccggatcgtccgcttactagacaatgtcgatttatacgaaaagttacagccagacgatgacttaaaggcgtacttgaatcaaacaacggggcctaaaactcaagttcaaaacggttattcgttggatgaaaagtatcagcgccaaatgaacaaagttatcacggaatttcaccaagcactcaatcgcatcaatgatgcctaccaagctgaactgatggcttgtggacaaggacaggctcattctgcggcagattgaattgcttgcaaccgccaatcaaaaatcaactgaacacgaaaacacacttcaaaagtagcagctttgaagtgtgttttcgtatttaacaactgcattgcaattgctagttgaccttgcatcaatcaactgtggtgacgcgatgaaattccttctgactcagctcatcgcaaacaattacacacgattagccccatcatccgtcctacttagcaacaaccgtggcaacttcttggtcgtggctcacttgtccacttgtggataaactgattttttcagcgggttgcccacctttatccacaaccaccaacaccgtcatatcctccccattttcagcggcctgctcttgatccacaaaagcgagtggtgtttctggtgtcacttggtcgccttcatgaacataagttgccggagttgcgctggtattaacacccattcgtaaccgtaccgtcagctttccagctgccagttcgatcgcattttgttctggaatcagggcactgacggttcccgttactggactgaagatatggtggcgttctggcgtcaccgcaaaccccgtctgacccgcagcgactgtggctaaatctatcagtgtgccatcgactggtgcatataatttaacttttttaccaaatgaaaatagtcccatgataaaaccctcccgaatttgatgaatagatttccataatggcgctggccagctaccgttctttgattacctttatcctaactgctcgaacgggtttcaggtcaagggttttatttaatttgtttgattaatagccattttgaatcagcagccgtcctttaaaattaagcactgccaaagtaacgtccacactacatgcttctctcgcttactcgcctgcacaccctcgcagtaccgtatcgcggccacagccaccaccaaaaaaattccccaccagcaattagccagtgaggaatcgtaacatatataacatcctgagatgcccaccaccaaaacaatctaggatttggttagtgtttgattatcactcggacaagtcccaatcatgttaaagcaaccaccgcacacgttggtgattcacgattgcattgactttcccggttaaatcctaattatctgtcgccgagtaacttttcagctgcttgtaagacattttcaccattcatcatgccatagtcggacatattgatgatatccattggaatcccagccttatcagtcttcttcttcacgtcattcgccatgtagcgaacttgtggtcctaataacaagacatcgggatgcggatcttgactcagttgatggtcaatatcagccgctgaggtggcaaagatcttgtaatcaacaccatcttgctttgccgcagcttccatcttagacactaatagtgaggttgacattcccgcagaacatgccaacataataattttttcagccataattatttaattcctttctataattacatcttttcaatttcagcgttaccagcagcagcttccgcagcggccttttcgccttcttccttcgttaagatagcatcgtacttcttagcgaatgggaagtaaattgcagttgacatgaccaacgtaattgtttgccagatagccatcttccagccaccaatcaggaagccagaaatgattgctggggtcgtccacggtgccgcgaaaccattcaatggtggcacaatgccgaagtagatgaccagataagtggataaggccacgataaccggtgtcaagaagaatggaattgccaagaatgggttcatcacgatcggtaacccgaacaagaatggttcgttaatgttgaataatgctggcacaaattcaactttaccaatcgtcttaaattgaacggacttagcagcaaacaacgtaaagataacaagtccgatcgtaatcccagaaccagttaagttaatgaagttattgtagaattcattagttacaatgtgggcaccttgggcaacggtcaacttacctgctttatataatgaagcattgtcgaacgtgttcggaatcagtaacccactagtaatggcacccatgatcaacccaccatggaccccaaagaaccagaagaatggcactaagaacgcaataaccagcgcaccaccgagtgaatcggataatccttgaagcggtgtttgaagaaccttgtaaataaattgcaacatgtcagtattaccgaaagcactgaaggccgcaaagattaacattgcaacaatcaagatgaccccggcaggaatcatggcagtaaattggttggcaacactggctggtacttgttcgggtagggtaatcttccaacctttacgaatcatagcggagtaagcccaaccaactaagataccgacaataatggcagcgatcatcccctgaccacctagccaggtaatattaacaaccccagtaacgggtgcttgcacaaaattttgtaggacctttggtaatttatcgatattctgtgaaacggcgctacctgacatcacgacattcccagcagcattggtaatcccagtaccggctttacccatcgcagctactaatggattggcaatgttaagcgtttgcaaaagtaagaatacggccatggaagttaacccagcgggcagtggttcatacccttcgttacgcacatacacataggcaatcccaacggccgcccaaagtgaaagaaccccaaacgttactgtataggcctggttaaagaacgctgcccaaccagaggccttaataacagcagccacagctggaattggaatattagataagatcaagaatacggacccaatgataataaatggtaaggcgtagaccatcccgtcttgtaaggctttaactggtttagtgttaacgaacttcattattggcggtaaaactttgttgttaatgaaattgctaacagcaccattactactattttccattacaattcatctccattttttgctaggaccccttgcagccaataatatgacttcttgggaacccgctttaagtcttttagatcatgattactccggttaacgtaaacaactccgtaacgtttttcgatatctgcgtgtgaacttggaatatcaatcaagccccagccgagataacctagtaccttagcgccgtcgatcaacatggcatctttcatcgccttgatatgttcttcatgataagtaatccgctcatcatcttcgatcatatgctgaccatcccagtgctcgcgtaacccaatcccattttcaatcgggaacacgggtacttcgtactggtcatacaacttggtaatcaagttgcggaaaccgagtggatcaatcgcccagccccattcattagcttgtaaaaagcggttggcctcaaatgaataattgagataacgattcggaacggcatcaacgggtattttatccccgttgataaccgttgaacgataataactaaaggccaaaaaatccgctttcattttgccaatgattgcttcatcacctggttgcaaatcataatcgatgccctgttgttcaacgtaacgcaggacttctggtgaatagtgcccgtgcacgtaagcgtcattcaagttgtcgttcaaaaattcgtcactcttacgagccgccataatatcaattggcttagctgtttctggataaaccggggtgtaagctaacataccaccaatcttcacgtcatcgtagttctgatgaacaaagtcatctaggcgcgcgtgtgctaacatagtatggtggaaaatccggtataagtcgttaacactttgatcacccttggtgtaccctgaaatgttgaagacttcgtcggtaaagtataaattatgttcattgaacacgatccaatatttaacccggtcagcaaagtgggcaatcatcttttcaccaaaacggacgaacgcatcaacggtgtggcgcgacatgaacccgttttcattttcagctaaggctaacggcatatcaaagtgatacaggcaaatcatcggtgtaatcccccgtgccagcatcgcatcaaccagccgatcataaaacgcaatcccagcggcattaaactcaccatcaccatctggaactactcgtgaccatgaaatctgaattcgatacatattcaaatgtaagtccttcatcaaatcaagatcttcctcgtaacgatgatattcatcaatggcatcatgccaatccgaagtggttgctgtcgcaggacgaacatcataaactgaacggcccttaccgtcttcatcccaagcaccctcagtttgcatacttgacactgaattaccccagaaaaaatccttgggcatctgtcgctccttatccatcaaactcctcctctgtgtcatttattttggaaaacgctttcctcgtgaaataatactatcctatttctatttcaaaatcaatacttttactttaaaaatatatacttttgttaaaataactaagtccggttgccactaaagtagctacaaaaagcggcctggcagtaaatactactgctagaccgttttgatcgtcctatttattcaaaccattcttaaccagtgtatcgacagcggctaataccgcagtatcagctgagagcgcttgccaccctaacaattgctgggctttttgggtactgacctcgtgattgatgcggatcatcaaactagactcgcgtaattgcccactaaatggggctaacccccgcacaaaccagtctggaatcaaatgtttcgtcaggcctgcagccaactgcggccgttgttcttgaatcaatgttttgaggtcccgcatcgagattggtgtggcggccactgctagaaaacgctgattggccgctgcaggcgccgtcatcgcccgaacctctaagtcagcgacatcgcgaacgtcgatgacattgactttaaggtttggcatcatctgcccagttaatatccgactaactagattataactacccgtgacgtgcccattaagcgatggcccaagcatggcaccggcattaaccgtcgtgaattctggactatcagcatgcgccttgcaatacgcccagccagcctcttcagcaaccaacttcgacttttcatacaacgaaagccccggttggtcttcgcgggtccagtccacttcagtgacgggatgatcatgatccaaacgactgaagccaacggcaccaaggttggcagtcatgacgacccgcttaacaccggccgccgtcgctgcctttagaacacggatcgtgccgaccttggccgcactagtgacctcatcagaagcctgaccttgattaacaaatactggtgccgcaacactcatcacatacgtcacgtcacgcattgcttcggcccaaccctgatcctgtgtcagatccagagcaacaaatgtcaatcgatctaagttaggtgtacccgctagcgtctgcttcacaccagctgctttatttaacgaccgtaacgttgcccgaaccggatagcccgctgttaataattgtttaatgatatgactggctaagaagccattaccgccagtgactaatactaatgatttattcatgtttaattcccccggaatattggttgtttttttcatcatggcttgttaatatagctaatataaaccttagacaatactctaaggcaagtgttaggaggaatctttttgacctatacgattaaagaagtcgctgataaggtcggactaagtgcgtacaccttgcgtttttatgataaacaaggcttaattccctttgtcagtcgcaatgaatccggctaccgagcatttacagacggcgatcttcatctattacatacgattatttgcctcaaaaataccggtatggcaatcagtgctattcgccaatatatcagttatgtcatggcaggtccccaatcgattgcacaacgacgagagctgctgacgacccaccgcaatgccattcttgctcagcaagcccaaatcatgaaaaatctgaaggaagtggattacaaattaaacctatatagtgatccgcacgcgcgtgaattagtgcaagaggaaattgctcaagcgaagtctgaaaaacaagccctcggtttagcagatccatttccagtgacggaataaactgttaaatagccgtgtttgacgccattttcaagcactaaaagccgattatactaaaataatcggctttttttatggctgaattttgggtgatttcacgtcataatgttaattttaggtaagcctcaacttggttaacttagcttgtcactgtcccctatcaaccgatttaaccagcctttttcaaagtcacagttcggttacgaagattacaaaagtccgtattcttgtaatctttgcattgcgttcttaaaactcgcgacactaacaagtaacacggaggcgttagactgggttctgttgattgcgaatgacatcgcagttaagatttttgtcagtaacttatttaatcgataatcacaaaatttataggagtgtctaatttgaaaaaacttgtaagtacaatcgtaactacctcagctgcagccgctggtttattattcgccggtgtcctcaatgctaacgccgactcaacttacaccgttaagagcggtgattccgtttgggccatcgcacaaaaattcaacacaactatcaatcatgttgaaacgactaataacatcaagggtcactacatcttacctggtcaaaaactatctattaagacgagttcaaccagttctgataacaacacctcatcaacgacttcaaacacaacgagttcaagtgcttcaacgactagttctagttcaactagcaacacaaccgcgacgaccacttcaacgagttcaactgactccacgacttcaagctacactggtagcaatttgaagagttacgttttaagtcagatgcaatcacggactggtgtctcagcttcgacttggaacacgattattacgcgtgaatccaactggcaaccatacgtccgcaacagttctagtggtgcctacgggttattccagaacatgcacatcagcagtggttctgttgaagaacaagttaacgctgccgttgctttatatgaagcacaaggtatggctgcttgggccctttaatctaaaactattaagacaaagtcgggattccttcccgactttttttgttgcgttaaattactttctataatcaacatccttttaaacttataagaacaataccggtattaactatttaatattgggaatgtcacgttaaacattgtaattgccgctatttttgctaactggctcaactatcggtaatttcagtaattattatattgctatttctgtcatattttttatattagtagccgatatattgtcaccgatacgtcccgtcacgatagtcttcaactattcagtaaaatatttactccccataattttctcagaatctcgcaatcgcttcttaaaattagcgacacatgcgagtaataagtcgccgctatactaatttttgttgatcaacaattgtacgacacgctgattgcttacaaaaaatgggagagtataacttgaaaaaattattaaccacaatcttaacaacatccgctgcaacggttggcctactattggccggaactgtttctgcacacgccgacgcaacttacaccgttaagaagggtgactgtgtctgggcaatttcacaagaatataagacgacgatcgaatcaatcgaaacagccaacaacattcacggccatttaattttaccaggccaacaattacggattccaggggtgaacgcccaggaccttactagtcaagcatcagcgacaccggtcgtttcagcgccagttcagcaggcaccggtcaccacaccaacccagccagctgaaacacaggccgcaactacgactcaaacaacaccagcacaaactaacgagacggttacttcggcaccagcaactaccccggcaactgaaagctattcgggtgataacctacaaagttacgtgctcggtcaaatgcaagcacggactggtgttgacgccggaacttggaatcacatcatcaatcgtgaatctaactggcagccacacgtcgttaacggcgcaagcggtgcatacggtttattccaaaacatccatattagtggtggttccgttcaacaacaaatcgacgccgcagttaacttgtaccacgcacaaggcatgcaagcctgggccctctattaaaaagacactaaaaaaggctggaattttccagccttttttgccgttcaacgattgttaacaacgcttcaactaaccacgattaacgtgacttgtgccactcgcgacccctaattatgatccgcgtatattaatttgccgtgttaataatcaccaacacaacttacgtcaagtgggccaaatggtgcgcataacccaacgcaatcacgataattcccacaatggcactcacttgatagattgggaacagtgtgggccatacccagccgatgccaaccatgccgtaactggcgattaataacaatagtccggtcatccagttgactttcttccagatcactggcgagttgtacgtccagggtacccggataccccaggtcacattctgcggaacatccatacaaattccaccaaccacactggaaagcacgccgagtgtaagcccagaattggccggctgaaaccataccggaacgactaaaattaagataagataccccaaccaccccattaccagatgatccgtcatcgctatgaagtcaaacggcgtcaacgctaagcgattggtcagccatggggccactaacaagaatagaaaagcgccggtcaagtaaaccaaccctaaccaagtaaactgttgattgcccaattgcaacggctggccgattagtgagcggccccacgcatacatgatgattaacgcgctcatcgtgccaacgatttgtaatctaactggaatcgctgttcgttttgccaattgtgccatccccccttgtattgttaacctaattataggcaggcgccagctacctaccactaatatccggtgttcaggcacatcattgccattatttaggcccctatttcgttagttatccactataattaagactaaactgattaggagaacgttcaatgaccaccatgcaattgattcatccacaatggctgttaataaaatcggggctcaaaacaattgaaatccgtttaaacgatgcaaaacgccaagccttacaagtcggtgacattgtaaatttcatcgatctgacgactggccagcagctcaccactcagctcatcgacatcacgcgtttcgctagttttgaatccttactgagcgaatacaccgccgttcaagtcggcagtgccccgggaacgccggtaacacagatggttcaagaaatgctaacgttgtattcccccgtccaagttgcgcaatcgggcgtcgtcgccttgcaggtccgtcccttaatcggacaataactggttgagctggcgatactgtgccaacatccactgttgataagtcaacttagctggcatggtttcagtcacattcaacactggcacctgattcttcttggctaatgacaccatgttagtcactaatttatcactaacttggctgttattcacaaagaaggcgacttgccgactctttaatgcctgctgcatcttgtggataacttgcggtgctgggtcagtgcccttctcaatcgcattttcaaagtcttgattagcaaccttaaaccctaaactggtcaatgcgtaatcaaagacgggctcactgactaacacttgccgattctttaacttgttagccttcgctcgtaacttggcctgttcctgttgaatcggtttaagcgtggcgatgtacttgcgggcgttggccttaaaatacgtgcgatactggggttgctttttagctaactgattagcgagatagttcgcggtggcgggcatcgttgcactgtcataccagagatgctcgttagccccttccttgcgatgcatcacgtcctcgccgacccgaatcaatttggctcgttgcgtcgagtgcacgaccttgttcatccagccatcatagccgatgccattagcgatgacgagatcagcctgaccaaccgtcttagccacggttggtgttggctcaaaatcatggggatcaacggacggtttgttgataattgacgtcacgctgacgtgcttgccaccgacagcttttgccacactaccataaaaattcgtcgtcgcaacaatgttgaccttatgcgattcagcagtcgttgacttagactgacagcccgtcaacaagcccccaccaataacaagtccacctagtaatagccacaaacgtttcacaattgccactcccttttaaatagtaatcattacgttttaaagaatagcaataaatttcattcttgtaaatagtaatttttacgttttacaattttattcgttaggagtttcttatgaaaaaaattctgattccgattatcactgttcttattatcggtaccattgttggtctcagcaccctacaccgcaccccgcgagccaccacaactacggttcacaaatcacgcgttatccaacaaccacaaccgattaccgaaacgaccattgctaaacagcctgctttaaaatacagctgcattatttattacgcgatcaagcacttaaagattcagcgttggcaagaagttagtgatttcagcttgggttggcaggtcgaaatttacactgaccaggggcaaactaagtatctggtttggtctgataaacacattaaggcagatgccaagcaactccagccgaactggttcacactcaaaaatgaccatgtcacttatgacagctttggtgttcatacttttaaaaaagatctgactgccacagtcagtatgaggaccattctagctcagatcaagcgtgaccacgcgacgaaaaccgttcgccacatgccaactaaccttgtaatcaaagatcatcgttgaacacgcttcaagttaacttttccattctcaggaggattggaaaagttttttttatccacgtgttttccgacccatttaccgtatttagttagtgtctactaattgatttggaaatgaggcttgtttaatgattaccaactggtttgatgatgatccactattcaatcgttactatccgtacgatgccggctaccggtattactttgaacacgaatggggtatcccggttcagcgcgatgaacaattatttgagtttctgagtcttggcggttttgccgctggtctcaactgggccgtcgtgttcaataaacgctcagcattcagcgcagcatttgacgcctggcaaattgaggtggtggcagcgtatcgcccagaacaaatcaccggtctcctcagcaattcggccatcatacgaaaccgtcgtaaaatcgaagccgtgattcacaacgctcgcctgattcaacaaattcggaccacacagtcttttaaagactatctctggcaacaattgggccatcaacaattaattatccagccccagtattatgatgaactcccacgcacaacaattactggcgatcgcatcgcacagcacttacaacaagttggttttaaatttgtcggtccgataacgattaatgcttggttggtaaacaccggttttattacggcacgtcccgaccaactgggcattattacgacgactccccggccttcgtcaacgatgctgcccccacgctcaccgcaccaactcgggcattttaaaccttaacccaggcttgttgcgctgctttaattgccgttcggcgtatctagcgcgaggcccgctgattttccctgataataacggctaaaaagccaattaaagtccataatcacagtcgctatttagcagttaaagggatatacttataccggcgtcatttaattcgaaccaacgcagtttttgcgatttgaaaggtgtttgcgtatgacttggtcacattgggagataactccatttattacaagtgtttttttcatcctaggcgtgctgacccttttttgggtatcacaaaattggattatcaacttcttcaatactcatcattggcgggttgaccaatcgcttattaccgactggtacggcttaatctacatgatgttatttgtctttgggatgcaaactgccgttgtgggccagaacgacgcctggattttcatgaatttccagctcatcgggctaactttttgtggctactttctcaatgtacgtgtccgctattactacttgtacccgcttgtctttatctttatgggcttcaatcactccttgtattactgggagtcgtgggggcacgccgtcacactgatcctcttctttacggcgctcggccgattgcgtaaacacgtcccactccaaacgaaacagggacaagtcgcactttatttagtcacttgtgctggttttggggccgttctctggtggttcatgaagcttaagttcaacttatcatgggcaacttattggcaagaatggacctacctactcgtctttgcttccttgctctatatctacgccagcatgttgtcagccaatgcacacctcaaacagaatctggtcgcattcgctaatcacgacgctctgaccaaaatcgaaaattttgcagcttacaaaacagccattaattatcaggttacaagcagtcggaaaaacggctcacaattgaccatgctgatgtttgacatcgaccacttcaaacaagtcaacgacacttatggtcacttggctggcgacaaaattcttcagcacgtcgcccaagtagctacgattgtctttcatgctaataatccgcaaatctcactatatcgaaccggtggcgaggaatttaacgttatcttccccaactatgatttaaccgaagcacttgcggtcgctgaacaactatttgcggccatcaatcatatcgctgtaccagttaatgatcatcaaatccaactgtcgatctcgattggcctatcagaattagcagctgatgaccaatcaccaacggccttttatcagcgcgtcgacgccaatctatatcattctaaaaagcacggacgaatgcaaatcaccgcgaaataaaataatcattaatcttaaaaggacggttctaacgactaattttagtcattggaaccgtccttaattaagattaattcgctatagaaacgctacggatattggccatcgcaatacttgctggtgccgttagataaatccgggcttgatgccaatcgagctttaccaactggctggttgccgtctgataatagccaacggtatcgttaaaataatcgacgttgagcaatggtagttttggtaacgctgcaatctgtttcaactgggtcgccacagctcttttatcctgagcatttggatagtgtttatgggcatagattgcagcgtgtttttcaatcaagtcatgataaccagtcaacgccgcgaacggcgcaaattgggcagcacggtctgcttggggcattggtaaatgccttgaagtaggtcgcgagcactctaaaatatccgcatagcgactcgtatcattaaataacgcagtagtactggcttcctttgtcattaggcacgatgtcccccaatctgctcattacgttcaatcgtagttgaactcggttttagatctgccaagcgaatgacgacattcttattcccggaacgacgttgtaatttcaaaatggcgcgttgcaattgcccatcgcgttcacgtttgcgttgtgcgtctcgttcttgcgcttgggccacttctggattttcaaataagttagtttgttgataccgaggttggcgcctaacctgctgttcgtcgaccaaatggttcgccataacggtcacacgtcgaaccatcaattgacgattaacgacttgttgataaagctgttgatacgcagcccctagctcgtgttgtgaagcactcgcctgcgctaatgtcaccgtggtatgggcgggctttggtacttgtcgcccatagtagtcttcggtgaccgcaccctgataatgcgtgccaactgacgaagcattagcatcgtaatcaatacgaattcccaactgatctgtcaccacgtggcgagcaaccagttcgagtgtcaaattattcaccatgccgcgtaacacggcctgcccttcagtataagtatacggtcgcatcaacacttgactggcatatataccatgttcgctagcatggtaatttttgatgtcagcaattgttgccgactcatcgccccacgcatgatcaattaacagttccgcgtttttaccaaactcacgatataattgttcttcattatgagaatccgacaaggttcctagtgaacagcgcgcaatgtcacccatcgtattgagccccagggctgccaaccgcttagcatagccatgaccgactcgccaaaaatcagtcaacggctcgtgcgcccataagtattgccgatattgctgctcatccatctgtgcaatccgaacaccgtcagcgtcagcgggaatcttcttggcaacaatatccatcgccaccttagctaagtaaagattagcaccaatcccagccgtcgccgtaatcccagtctcggcctgaatctcgtgaatcatcgtctttgccagtgcgtgcggtgaaacctgaaaagtacttaagtagtctgtgacgtccatgaagacttcatcaatcgagtacacgtgaatgtgttctggcttaatgaagcgcaaatagatatcataaatcgcagcactcttctgcatgtaataactcattcgtgggggaacgacccgataatcgatacccaaattagcatgcttgaggagctgatcacgataaattgagcgatgccgccgaaccgcctgataggaagtctggcgaccacgggcgcgatttaaagttgcgacccgttgttcaacttgaaataaccggggccgccctggaacaccaaattgctttagtgctggcgaaaccgccaaacaaatcgtcttatcagtgcgactcgtatcagcgacaaccaaattggcattcaatgggtcgagttgatgagcaacgcattcgactgaggcatagaatgattttaaatcaattgccatgtatgttcgctgttccatcaatataatgactcccttccaattaatcggcacaatcgcagtcgttgttcaccttaacattttgctggtaatccaaaataaacctcatgctgctgatcgaattttaacgatagccgcatgtcgctcgcccccatgacactcacttttggatgaaacctgactcaataatttgtcgttaaaagaacatatgttcttttaactaattataaattaaaatcaggttgaatgccagtatccgttaacaaataattgcagacttcaaattagacttaagccccaaaaaggcacccgtccaccagcacgtaccgtgaccacgaacagttgcctttttaatgtcattttatgagtggctctgcgtttcagtcgggaccaacttcgtaaattcatgtagaaaatctgccgtcttcttacccggaaacttggtgcttaataccagccataatagcgcttcttaacttgcacaaaagaggttatgccacacactgacgcatgtggcataacctctttttgcatatcagcaatcaatatttaaaacaatatctaccgaaataaaacctattgccctgccgtactttcctgctccaacttaatcgtcaacaattccgggtcttcattgactaacgcttgtagacgtgaaaatagcatcagcaaccagccaaacgaaatcgcaaaggcttgaatctcaaatgccgtcagcgatggatacccaaaccagcgaaaaccaaagttgagtagtaatagcaccacgccaacgccgtatgagagccacagaaaatctttcgtcacggctggtaatagccaccgcacccccacaatcaacaagactaacaacgtgaccaagccaccagcaactaagtcatgtaaccagtgaaacgtcaggttgttaggaaatagcccgaccgccccgaaatcgacagcggtcaacgtcaacaatatccgcaaggttgacgttcgccaagtacgcggataaattcgactaagtgagacaaatagatagtcaatcagaacgaccatcaataacgccgaaaaaatcagtgtcaagttgaattgccaggcattttcagcggcatgcgtccctaaaaagcttaaattatgctgccaccatcgccgttgaccattggcggccattgagataacacagccactgacaatcaccaccgttaaaatcgttgataacgaccgcgcatttatcgtcaacgcagcgctaatcatgaacgcatccgcaaaatacgtaaacaagaccagtagcaacatagatgtaaagcgatcgaagatgacatctggaaataataattctaatacccagaaagccccgaccagcgcaaaggctaagatcataataaacgcaatcgtaataactggaaagttccgccaataaatatggcgtgaaaatcgattttctggatcattacgcgtttttaagaaaaagccgacaaatagcactgcgccggtaaccacaccggccacaatcgtcaaactcccgattgattgcgcacctgtcagtggaactggtcgcactttttgaaaccaccagtacccgtaactggctaaccccgataggattgcaaccaacagcggccagattatcaagtattgctgccactgtggttgacgtggcttaatcttctctaagactagtgcgtcattgcgcacctttaactgtaactgatcatcgcgatcaatcccggctcgttttaatgctgagactgggattgaaacccgcacttgttgctcttgccctgccatgtccgactccttatactttcattactcaaagaccatctgattacgatacagttccgcatagaagccgtttgccgctaataaatcatggtggttcccctgttcaataatttgaccatccttcaatacaacgattttatcggcattcaggattgttttcaagcggtgagcaatgacaaagctggttcgcccttggatgacgttatctattgcggcttgaatattggcttccgtcaccgtatcaacgttcgaagtcgcttcatccaaaatcagcaacttgggatttgttaaaatcgtccgggcaattgacatcaactgcttttgaccggcagaaaaaatactctgttcgtcggaaacgcgcgtctgatagccatctggcaggctcatcacaaagtcatgaatattagcctgcttcgccgcatcgatgacccgatccatactagccgttgggtccccgtaacgaatattatccgcaatcgtgcccgtaaacaactggggttcctgtaagacaatcccgacattttgccgtagcacctggagatcaaagtcttgaatattcaccccatcaaacgtaatcgcaccactatcaacatcatagaagcgattcaacaaattcatgaccgtcgttttccccgaaccagttgggccaacgagtgccaccatctcaccgcggtgcacatggatcgacacgccatgcaagatttctttacctggtaagtaactaaagcgcacattatcaatcagtaattcatcatgaatcccgtcgagcgcttgaccgttagcggggctcacttcatccgattgattacggacttcatcgacccgccgtgcaccagtaatcgctaactgaatcatactatataaactagtcaatgacataattggctggtagtactgttgggcgtagttaacgaacaccacgaccagcgccaaagctgctccagtcgacatactcccattcagcgctaaccatgagccaaagaagatgacaattgccgtgttaagcagtgacatcccttgcatcagtggattcaaaatacctgaccagatttgacccgtcaacgctgactggcgaaccttaccattatactgatgaaagcctttcaaggagtcctgctgtaagccgttggtaatcaagactttttgaccggtaatttgttcattgatataaccattcagttgaccgatatcatcctgttgttggttcaccgcgacgccagccttgtgcatgacaaacgccgcgataattaatgcaacgggcgtagaagccatcgtcacccacgccatcgtagtgttttgattaaacatcacaattagcaggccaacaaactgagccacggctaataaaatttctagcaaggcttgattcatggcattaaaaatattatctaggtcagaggtgaaccgagccagaatatccccgtcactatgcgtatcaaagtattgaactttcatccgttgcatcttccgaaataggcctacccgcattgtcccggtcgaaaaggccgtcacgcgtgctaagatcaagctcgcaataaaaatcgtgctagcatcaccgacatacaacaagacgtagatgatcagggtccggttgaatggttgcaaacttgcttgtgcccgagtcgcttgattcgtccactgctgcaagtactgcgtcagctcctccacggctcgtcccagataagtcggtgcgaccacaatgcaccaagtcgaaaaggcaatcagaatcacacttagtaagaagcctaaccagtagcgttttaaatagtgccagtaatatttaccagcattgcgtaaatcactcatgtaagccctcctcccgtgctttttgcgtttggtaaatagcgcgataaatcgcactatcttgaagcaattcgtggtgagtcccctggcccgaaatgcgaccattatctaacactaagatttgatccgcacgaataattgaagcaattttttcggcaatgaccacggtcgtcgttgacttcaactcgcgatccaaagcttcttgaacaagtttttctgaacgcgcatcgagtgccgaagtcgcatcatctaaaatcaagatttctggattggcaatcacgccacgcgtaatcgctagtcgctgcttctgaccacccgaaaagttctgtgaccgttcttccacgggggcatcgtacgtctgtggcaaccgttcaatgaattccgcagactgcgcaatattagccgcccattgcatgtggctaggctgggcgtccggcttaacttgccgtaagttacccgcaatcgtgccagaaaataacgtggaccgttgtaagacataggccaccgtggatcgaagggctttttctggtaaggcccgcacatcaattccaccgatggagaccgtcccactatccggatcatacaaacgcgcaatcagctgggccaacgtcgtcttaccagatccagtggccccaacgattcccagcatagaccctgcttttaccgtaaaggtcacatcttttagcgttggctgcgcatctcccggataagtgaaggttacgtggtcaaagtgaatatcaccagctacgggcgccgcgtcgccatcaacgtaggtcatacttggttcggtagtcatcacttcgccgattcgaccaagtgagatgacggcccgcgacgcaaaagtcatgagaaagcccccgttgatcacggcaaataaaatctgcattaaataagaaataaaactcgtaatagctgctaaataggccgggtgcgtcgtaatcgtttgaccgaccaagtaaacggcgaccccgaccgccacgttggccgtcaaaaagaacgccggcattagaatagcgaaccagtacccaattttagcggtcacagcggttaattcatcggatgcggccgaaaactttttgatctcgtttggttcttgaacaaacgatttaacaacccgaatccccattaagttttcgcgggcaaccgtattgacgttttcaatatcttgttgcgtttgtgcaaagtatttagtcatccgccgcaccgcaatcagtgcgacccctaagattaccgccatcatgacaacaatgacccaccactgctcaggcatcgtcatcacagcgagaatcagtgctccgatgaatagtaatggaatccgggtaatctgctgaaagccagccatcacaatctgttggacttgattaatatcgttcgtcattcgtaccactaagttggacggtgaaaatttttccacgtcagcgtaggctaatgactggaccttagcgtataggtcagctcgcaagtcggtcgccacaccaagggccacccgggctgcgtatatcgtattcacgatcccaccaatgattcccagtacggccaagccaagcaacatcagcccttcacggaataccatagcctgatcattcttgataatggcttccataatgacttgcaataatcgcggttgccataacgtcgcaaacactaagacgatgaccgacagcatcgcaatccagacgtctagtcgataccgcttaaaatatggcatcaaaatcttcatcaatcgttcctcctcataattgtggtctcctgtttagggtacctgaaattaacagtcaggacaatcaatatatcatatcttttgcaaaaacagattacgatgataataattcagtatgtgtgggagaaataatgaatacgatgtgcagatataacaggccctttaaggccattcaacactcacacacagttacaacggccgttacctatagaataaggaccacatttacatcatgtgatattttcccacatcactaaattaattatttagataaccaactaattatcgacaatcttttactggcaaactgcttccctgctataatccaactaagctatgggggctaaccgtatccatgtcattgcatttaaccaccacatcgacagcactaatccaatcagccaagacaccgaacgccttgttagaaaggagtactcgccatgcgtgttaacaaaggtttgctttcagttattgcagttaccacagtcgctagcttaggaggactcacgacaacagccacggccgcgactaagaaggtcacgactacttacagtttccaatcccatactttgatcattcggggccaaacaagtcatcacgccaaactcgtcttaaactatcagggtaaacggtcgcaacttcgaccgttaaagccggtaaattcacgattactcagccgtttcaaggttacggaacctttaagctcgtcgacggctcacaagtactagcaaccattccagccaagcgctacgcggcgccgcgagtaagagtcatcagtgctgaacaaacggctaagggcatccattatacggttgccaatgccagtcacacgacactcacgattacgcaaaatggtcgttacctcaagaccattaaagcaacccgaccaagaactaaccttttcctttcgaacgcccaactaaaacacggcagtcatgggctacgtattactcaacgcgtcccgaataagaaaactagcccagctgttaaattacccgtattaaaagcaaacattaaacaagtcactaatttttaatccagattacgactaaattcaaaaatggaccggtagcgatacgatcaactaccggtccattttgacatccacatcatcgtcagttggcgcatttaccatctcgtgctaatactatcatctcacacatggtcacgctgcccactatgccagagtatgtctaatgactgtctgccatagcatgatcaacaccaagcttctcgtttgatgctacactaatgatagcgcctgactaacgatcagaaaggaagattctaatgacccttcaagcacaactcatgcaacaactcacggcggcggaaccggaaatgatcaagattcgtcgccacttacacgcccaccccgagatttcatttcatgaagaacaaactgcagcttacatcaaagcgttctatcgtgaactgggcgtctcaaccaccgcttatggtgatgggtacggcttcgtcgtcgacatcgatagcggtcaacctggacctcaattagcattacgcgctgattttgacgccctcgcgattcaagaagacaaccacttatcatttaaatcgcaaaacgccaatgtcatgcacgcctgtggtcacgatggtcatactgcttatctcatggtactggcgaagaccttactcgggctgaaaaatcagctacgtggtcgcgtccgcattatccaccaacccgctgaagaagtgtcaccgggtggtgctaagggtatgttggctgctggtgtcctagacggcatcgataacgtcattgggctgcatgtgatgagtaccatgccgacgggctcgattgcctatcacttaaatgcgacgcagaccgggcgggctaattttacggtcaccttcacgggtaagggtgggcacgcctcgatgccccacctctcaaacgatgcaatcgttgctggaagttactttgtaaccgccttacaaaccgttatttcccgtcggattgacccatttgataccggcagtgtcaccatcggctcattcgacggcgtcggttccttcaatgcgatcaaagcgcaagtcaccctcaagggcgatgtccggattatggacgaaaccacgcgccagaccatccgtgaccagattactaaaattgcgaacggcgtcggggcgactttcggtgtccaagttgcacttgattacgatgataattatccagtactcatgaatgatgcaaccctgacacagcgcgtcatcactagtattcaagccgctcagattccagaaatcactaaaattttcgactgtggcccccaagacccctcggaggacttcgcctattttgcacaagccaaacccagcacctttatctatgccggctgtcaaacagctccgggtgagacccacccgcaccacagccctgattttatgatgaatgaagactgtttactaattgcggccaaagcggtgggaacggcagcgctggattacttaatgaacgcctcatcagatcattaaacacactaaagtggctaccttgaatgtatccatccaaggtagccacttatgatttattcaagccaatcaggaattaacttgcagtgaacacctaattaatcacgccgccaccagtcacgccataaatttgcgcggtcacatagctcgcgtcgttagaagctaaaaagacgtacactggtgccagttctgcgggttgtcccgctcgtttgagcaaggtgtcttggccaaatttcggcagcgcctcgattggctggccttgatctagttgtaagggcgtccagattggcccgggagcaacgccattgacccgaatccccttttcggccgcttcggctgctaaattaatcgtaaagttcttgatggccgccttagtcgcagcataatctaatagatgaccactcggcgcataggcttgaatcgaagtcgtggtgacgatgctaccgccagcgggcatctttggcaaggccgcctgagccaacgcaaacatcgcgacgatattcacttcgaaggtcgcacgcacctgttcgatcggcagcttagccagtgaaggttgtgaaatctgttgccccgcatttaggacaagggtgtcgataccaccaaattcagcgattgtccggtccacgaggtcggtcacaacgtcaacatccttgaaatcacaaggtaataataacgcttgacggcccgcagcgcgcactagttcggcaaccgcctcagcatccggctcctctcccggcaagtactgaatcgcaacatcagcaccttcccgcgcaaaagcaatcgcggtagcccggccaattcccgaatcaccacccgtgatcaaaacgcgtcgattcaacaacttatcatgtccttggtaactcttctcaccacaatcgggttcaggacgcatcttagcttgtagtgcgggcgtctcctgatcctgcttatcaaagccatctgtcttatataaatagcgtgggtcacgtaattctggttgattcatgagatttcctccttcaaaagaatacccatagaataccggaattagttttcggatgatagttaaacgcacactaaataataatagttacgattagatattaggcataaaagctgtcatcgtcttaactcacttaaattgacgctgcttcaaaaaacgataggcaattattccaacaacgccgaccaaagtggcccgtaataaccaactgacagaccaccacgtcactaacacttttattaacgtcatcccatcattaatcgtcattcggctgttcctccgctaatgttgccaattgacccaacttccgctgaaagtcccgttgcatgacgggcttcactagtggcaacggtagccagctcggcggtgtagtcgtaagggagacttcttcctggaccgcagttcgctcggccaatggcgtcatggtgaacacaatttcatatcccaattggcccccctcactgtgataaacgacctggtcagcgccgactgtaacctgcaactgttccggctgatcaaaagccgaaccggaccgctgtaacacgtaccccgtcgcggttggcttgaccgtggtaatggcagtcgcccatgctggtaagttcagcggatctgctagcaatgctcgcaccgttgctggagttgcctgtgttaatacttgattggtaaataatgctgttgtcattttataacccccaatgttcatcctgacccggtcatcgttattacgcccaaccactccaaatcaataacgggccgttagatcaagtgcacatgtatttagttggtgcttataaaatacacggtggggacgccaacataaaatcagaatactgataatttacaggcggtcgttaatttgttctttaaacaggtctttgaaaacttgtgaccgttggctggcaacctgcgccgtggcagtctcccccgccgccattgcgagttgcgccatcaactgataaatattggccagcatgtagtgtgaatcgtgtgtagtcgcaaaggccaacccctgcgtcaaacgggccaccgccaactgggaatcatgttgttcataggccaccaacccagcaagataaaaaacaatgttggcattttcttcatatgcactcgcatcaatgtcagcgagtgcccgggtgactaaggccgcgactggggcttgaggatggtggtgcgccttaacgacggctaacgaaatcaaggccaagcgtgtcaacgttgtcggcggcgagctgggagcaaccataccaattgccagccgtaaattttgttgtgcagcatccgatgtgcgatcaacctgccaacaggcgacacccagataataatagtaagcctgagtctgctcatccgtttgaacatgttccaaagtggttggctgtaatagccaatccttcaattgctgatactgatgggcattgcacatctgccgaacgcggtcattaaacgcttgctcggcactgatctcaaaatcgtcggctaggctcaacgtactaaccgcgacccctaatcgctgacacagcgccagtaatagccgggcattcggcacgtagcgatcattttcaattgctgacagcatcgattgtgcacaaattccccgggcagcttgcttttgattgagttgcttggctttgcgtgcctgctttaacgcagttcccaatgtcatgaccattcccccctagatagcttttgctaatgagtgtactaaatttcccatattaaggcacttaaaaaataccattcaatgctgttttatcagtcagcaatcgaatggtattttgaaattggctatttaattgacatgccgttctcgaacttgataccaaataatcccggccacaccgaagacaattggtccaactagcatccaaatcgtattttgaatctgcccagtttccaagattggctggatcaacgtgaaaacattcgcacctaagacgacaatgaacacgacccaactaataattttcgtccaagtcaatgacttgtacacttcaaaaggcttaacaatgttctggttttccttaaacttcggaaacgcgtatagcaagaagaggtatggtaacgtcatcgaaacgttcgccatcaaggtcaacacattgtaaaaggctgacgcgtctgccgttgcaaaggacgccaccaaaatgatcacaatcacgatggcacattgaaccatcatggcataacttggcataccagctttgttgagcttcgtaaatttcttcggccacagttccttaggtgttcccaagataagcgtcttcaatggtgaataagttaaggtgaagaaggccccactgtaagcgaggaacatccctaagccggtgtaccgtgcaaaccacagtcccattgtcttagcggccgctgtactcaaaccaagcgcttgccctaaaacatagcccaagttttgcatcatgacgtaactaatattaccgaggttagtcgttggattcgacaaaacggcttgccagttcgtactaatcccccagcagaagattcccaggccatagcctaaggtaataacgatggcagaaataataattccgcgtgggaaggtcttttcggggttcttggtcttatcaaccatcccaccgagaacttctagcccaccgtaagcaaaaatggcgaaaacggcaaacccgagtaacccgactggatgctgataacttggatttggtgacgtcatcacatgttgtaacggttgtgcgaattgtccgtgattcaaggctaaaacgacccccgaaaccactaacaggattgcagtcaaactggtcaccgccaggccgcctaaactcgtgacccgcacaatgcctttcatccctttgatggaaacgaacgtcactagcaccatccatagacaggacaaaatcccaatcatctgcgtcgcattcagaccaaacatcgcaaagcgctgcgtttgatcgctcccaaagaagatggtcgtaaacggaatccagactttagctgacgttgagactaaccaaataatgtacgacgcaaaccacatgaacgtgcccacgaacgcaaatttcgcattcacactcacttccagccacttgtacatcccgctactatcagacttaaccgctgccccgaactccgccatcattagcgcgaacgggatgaagaacagtacggctgcgactaggtaaaatagaatcgagctgtaacccattaaataataggccaccgtactattggcaaatccgaaaacggtcgtaaagatcatcatgactagcgccatcaatgtaatcttttcattatcttttgttgccattattgcactccctcacttactcctttaatacttttgtaaagctattccaatttaagattaccgaacgaaggcaataaagcgctttagttttcctaacaatattatgattttttcatgtgatagtcagcgcaattattcatctaaacaattgccgcaacagttattgacaaaaactatttcataacggaaacgttcatttaataacatagtaacttctctttaacatagctgacacataattggcgtattctacacttatcagcttagggaaaatataaaacggggttatacatatcatgaaaaattttaactttaaaaccatgttgctattagttttggctagttgtgtcttcggggtcgtcgttaacgtgactactagtcttggaccacaaaccacaatcaccgcccaggcctccaagaagcttagccaagcccagcaaattgccaagatcaacgccaagctttcgaaagccaaccgcgctgccaaaaattggatcgcctatcgtgaatctggatacagttatacggctcgtaatggccgctgctacggtcgctatcaattgttgcgctcatacttacacggcaacttgtcacccgtcaatcaggaaaaacgtgctaatacctacgtcgcctcgcgctacggctcctgggtcaaggccaaacggttctggcaacatcatcactggtactaacccaatttttctattggatcacactaaaaagacgactaattactaagattgtgaatctttgtaattagtcgtctttttgtaggcagtaatatcaaatagcatgaggactatagttcaccgtcatttaacacttggttacaacaggtatgccgtgattgccgcaccttttctaaacgatattgtgaaaaatataattaattagccaaaaagtattgaaaattgtaattattacgactataatttgattcgtaaattagtaatgatagcgattacaatataaaaagaggttattaatatgactgaacgtaattttgatttcttaatgcctagcgttaactttttcggtcctggtgtcattagtaaaatcggcgagcgtgccaaaactcttggtatgcacaagccagtcatcgtcaccgacaaatttcttgaaagtctgccagacggcgccgttgctcaggtgcggcggtcactggatgctgccgggattgactacgtaatttataatcaagttgaacccaaccctaaaattcataacattcaagctgttaaagccttatatcaagccaatcaagcggactccctgattactattggcggtggttctgcccacgataccggaaaaggtgccggcatcatcatgactaacggcgacgatatcactaagttagcaggaatcgaaacactcaagaatgccctaccaccactgattgcggtcaacactaccgctgggactggttctgaattgacccgtcactgtgtcattacgaatgaagaaacgcattataagttcgtcgttgcttcatggcgtaacatgccactcgtgtcctttaacgatcccactctcatgctagatgttcctaagggactcacggccgcaactggcatggatgcttttgtccaggctatcgaaccctttgtttctgtcgatcacaatccgattaccgattcacagtgcatccaggccatcaaattaatcgaaacatcattacgtgaagccgtcgccaatgggcataacctagaagcccggacacacatggtcgaagctgaaatgttagccggcatggcctttaacaacgccaatctaggttacgtgcacgccatggcccaccagctcggcggccaatatgacgcaccccacggtgtctgctgcgcgctgctcttaccctacgttgaagaatataatctaatcgcgtgccccgaacgtttcgccgagctcgccaaaattatgggcgaaaacactgatggcttatcgactcgtgatgctgccgaattagctatcaaagcgatgaaacaactcagcgaagacgttggcattccgcattccatcaaggaaattggcgccaagatcgaggacttcgaacacatggcgactaatgcgcttaaagacggtaacgctttctctaacccacgcaaaggtactaaagaagacatcatcaagattttccaagccgcatatgatgccaagtaatcccccattcaaagttaactaaatcattcacagcaaataatcggttcaagaattcatagtaaattcttgaaccgattatttgattgggacctctctacaactcgaatcgttactcggcaatgccatgcaccccacgtttggacgcgctattcaaaataaacaccgcaacaataaaccgacaaacacagataagaatatctatcagaacacgcattgtgcaaattaatttgtcctgatttgtgattaaaacgtgccaagtttagattgttattcgtcagccggtgcgcgtcctattccgacctccggggctgggtgaggggccacgagttgaagccgagcattgcctggccaacggattaatgctgttttggcattagtccgttggnnnnnnnnnngcaattggcagaaatgcctggaggtcggtgtaggacgaactaactaaacaagtttacgctgagtcgaactttttcccagcggtccatagctggctgtttttgaatttaagaaccggcacgttttaatcacaaattatgcaagccgtccaagcggcttgtgtttaacgcaaaaaacagcgatgtcaaaatcaacttttgacatcgctgttttagaagttattcatcataactgatggcacccagccggcagctatttccccggttgataatcttcatcaatgatcaagacaggtttgatggtcttgccgctacctgaatcagcattagcttgattaatatcctcaaacttatagaacttttcggtcttttcaaatgggaacatgccatgttgatagaaatcgattaaccgtggaatatcaacgccagggatggcatcacccatgttaacaccaatgactttcttatcatcaacacacaaatcgttccatgagctaatggtgatatttttggccgtaacggcaatcaaagcagcagtcccaccttgagcaagtgcgtggattgcagaaaccataactggttctaccccagtcgtatcaacggcaaagtcgaccccgtaaccatgcatcaacttcttgattgcttcaactggatcttcttccttactgttaatggcatgagtagcacctaattctttggcgagttctagccgtgaatcaacaatgtcgaccgcaatcacttcggtacagccggaaatcttaccagccatcattgccgctaaaccaaccgcaccagtcccaaagactgcaattgtttgtcctgggcgcggctgtaaactgttcaaaacagtgccacttccggtgacgtagccgcagcctaaaggtcccaagcgacgtaaatctagttcttttggtactttaaccgcattacgttggtcaactaccgtatgagtcgtgaaggaagattggtcgaacatatcactgatatggtgcccgttttcttggaaatggtcggaaccatcgggacgagtcccactcaagttatagtcggcataattccgacatttagttggcatgcctttcagacagttatcacatgttccgtcagcgtaaaatgatagaataacatggtcgcccacttcaaaattagttacttctgaaccgaccttttcgacgattccagaaccttcgtgtcctaaaattactggataacctaacgacgcatcaccccgccgaattgcttcatcagaatggcaaattccagtcgcaaccattttgatttgtaaatcagttgctttcatttcagctaattcaatatcatctttaatgacaaatggatcgtttactttatcaaccactgctgctttaattttcatgttcaaaccctcgtttcaaatagtatgtaaaccgcttacaattaatattgttacacaatacacaatttgattcaagcgcttacaaaagcatctaacaccacacttatctccgttaaatgggcattcttctaattttacactaacgatatgatacttaattagtgtaaatctaatactctttttttactgattgtgaggaatttatagccagttttcttccttaaattgtcgactcaaaaagcgggtgtctaacgccagctcaacaacgtgaactggcgttagacacccgcatattttgtaccattaacacacatttctgcttgtttaacaagcccgatttcatccgacgctatctgctcatcgtctacgcaggttgggcgttcgaactgatcttagctttatttagcaataccgaactcgtgactacggacaatgaactaaaggccattgctaatccggccaattcggggctaagcgtcagcccaatggcaaagaagaggcccgccgcgactggaatcccgagcacgttgtacacgaaagcccagaacagattaagtttgatacggttaaacgtcttcttactcaatgccaacgcccggtcaacatcacgcagatcgttcttaacgagcacgatgccaccagcatcgattgcaatatcagttccggaacccatggcaatcccaacatccgccgtcgtcaacgcgggggcgtcattaataccatcgccgacaaaggccaccttgccagccttctggaacgcgtgaacgtgctcagccttatcacctggcagcacatcagcaatcacttcatcaataccgacttgatccgccacagcttgtgcgacccgttcgttatcgccggttaacatgaccgtcttcaagccacgtgctttcaaactcgcaatggctacctcagacgtcgatttggcgacgtcttgaatggcaatcaatccaatgatttcgtgatttaagcccacgtacacgaccgttttcgccgcgtcctgaagctcagtggcttggcgttgtaattcagcactaatcggctcatcagttaataatttatgattaccgaccaccgctaattggccctcaacttgagcagtcacacctttaccctcgatggcttggaagttcgtggcggttggtgcttgaataccacgggccgtgccgcgttttaatattgccgcagctaaaggatgttccgaagccgcctctaagctagtggcaacgcgcagtacttgggcttcgtcgccgataacatcggtcacttgtgggtgaccaaccgtaatcgttcccgtcttatcaaagatcaccgttttaacgtcattgacagcttccaagacctcaccatttttaatcaggatccccatcttggcaccacggccggtaccgaccattagtgcggtcggcgtagctaaacctagcgcacacgggcaggcaatcacgaccacagcgaccgcaaaaatcaaggcattcgcgagactagcattcaagaaaacataccaggtcaagaaggtaacgatagcaataattagcacaatcggcacaaagatatcagaaactttatcggtcagcttttgaatcggtgcgtgactgttttgtgcttttttaacgagctcaacgatttgagccagcattgtctggtcaccgaccttgctagctttgaactgaaaggtcccattaccattaatcgttgaaccaatgacggcgtccgccaccgttttttgaaccggcatactttctcccgtcaccattgactcatcaaccgttgagcggccagttgtaattacaccatcaacgggaattttttcgcctggcttgacccgaataatgtcgccgaccactacttgatccaacggcacttttacaaattcttgattgcgtaacacttccgcttccttggcttgtaagcccactagctttgcgaccgcgctggacgcgttgtgccgcattcgttcttcaaagacttggccgagcaaaacgaaagtggtcacaagtgcggcactttcaaagaagactgcttgccccgttgccattgcgtataagctgtaaaaataagccgtcgcggtgccaatcgccaccaaagtatccatattggcatggtgcttagtaaaggacgcccacgaactttgcaagaacggccgagccgaaacagccataatgatggtcgtcagaatcaactgcgtccaatcaccacccgggagcatccagccaaagggcatcaaaatcatattagccagtagtggcagggaaaatattaatgaaatccaaaaccgtttcgtcgtgctcatcacgcaatcaccaccttgccactcaccatgtccatcccacaactaaagtgaaattcaccggctcgatcagttggtaccgtcaccgtttgcggttggtcaaggggtaactcagtcgtaaagtgcaagtcggttgaatgtacttgctctaagcacccctgcgtactcgtgcgcgtaaacgttaattgggccggtacaccttgttgtaacgttacttctgctgggtcataatggccgtctactgtaatcttgatttgttgtcgtgcgctcatttgattttcctcccactatttaatgattaatttcccatgaaacatgtccatcccacaggcccattgatattcgccagacttactcgtatcaatcgtaattgcttcaacttgattttgtggcaattcctgattgataccgaaatcactgaacaccacgtgatccagacaaccagatgcatctttgcgcgtaaaattaagtaccgccggaaccccttttttcaacacgatttgctctggcgaatagccacccttaacctccacatcaacctgctgtaaatcatcaaccgcactcgcggtgaccgttgtcgtagcatgcttcccgaagaaccaccacagaataaacccaattgctaacccaccaattaataagactaatactttaatcatcattttattcgtccctttctcattatcgtttacacttgtaatctatatgtgtatattaatcccttcgtttacaattgtcaacgataaatgttatttttaggcataacccttaattttttaaacgccccacccagttgctactatcatatgtctgacatttagtgtcactacaaaaagtgccgcgtacgttcctttgctcagttattagtcaccatttcgaccggtcaactgaccgcatcaaaagtaccaacgacgatatcataaaaggcaatcactaccgtttaataagaaacgtcagtgattgcctatattaatcattcaaaactagctgtccctcaaaggaacgttaaccccgtcaatcccggttcctaaagatccgcaactcacaacgggtatcatatcacaactgttaatcgcgggacttaatcttcagccaacctaaaattgaactcaatgctaatccaatcatccccaagagtgataattgcgtattctgctcgtccgtctggggaagggtcgtcatccgatgatgcttagtggtacgttttgataccgccggtgcactaacccaaccaatacctgaaacggacgcagctgttttctgctgattcgtctgcacaacgctttgatctgactctgcttgtgatggctgtgacgtccgtgattgttcagcctgattacgactcaaattggcttgatcacttaatccatctggttgctcagaatcagctggctgactcggtttttgcagttcccctggtttttcggattgacccggttcttccggttgacttggttgctcagggtgccccggctcttctggttgacttggttgctcaggnnnnnnnnnntgccccggctcttctggttgacttggttgctcaggttgacccggttcttccggtttgattgccgatttcttgtaagtaaccactacaacctgatcggcagttgtgacactcacctgctgagctgccacttctgttaatgtggtcgtggcacccgctacaattggtgaaataacgcccgccatttccgttaccgagactggtacccattcttggtatgtcacttcgcccgtcactaaatcaatcatcgcattgcgttgaaattggacggtttgtaggaccgaggctgcggctgtcgtgccatcctcataaacatagtgaatgattctagtaacggtgtgcgttaaatcggtgtcgccaccctcatctggaaacaagatattcggattgtcaggatcaactggctgtcctggtcgagcaggattgcctggtgttaccgtaataatacgatggtcataagtcacgattgtcgtcatcaggtccggatcagtaatcgcgaccgtttgagccgctacagtccttatgtccggatcagtatagccttggacgactagcgttggtgacgttaccgcggcaaattgaccactgccaactaaaatccacgcataatcagcttgactcgtatcaactaatccatcaccgtttaaatcatagcctaaacatttgccagtctttttttcaataattgctgttcgttggtaaataaccaattgctggacggtcgtggcaatcgattgatgggtctgtcaatcaatatagctgataacgcgccgtttattttgatacaccgtaacggcctgagttgctagtcggtaataaacattgatcgtaacatctttatcatcgaccccagcaaccatctgctccggcactacttttaggtccggcgctgcgtagccctcatggctcagatctggcgacttaaccgcgccaaaccacggccctgaaccaacaatcaaccatgcttcatctgccaattgtgtctcaatctgtccgtccccgttggtatcgtagccaagtatcgttccgtcatgagcaaccacagctaataattgatacttaaccgtttgaacaacagcatgtagtgacgcgatgggttgcagtgttccaccatcgatatagttaatcgtccgggtaaccgttcgctgcgtcgttgcaatatgcgtttgttgctgatacttgacaattacatttgtattcatcgttctatcaccaccattaatgatcactgtttgccccgcaactaccggaatatcaggagcttgataaccctgcgcagataagtctggtgagacaacctgtacccaatcttgatccgttggcggtactaacagccatgcaattgtcccatcactagtatcaacaattccgtcgccgtttgtatcatagccgagcaattcatgagttttagcataaaaaatggcaaatcgcacgacccgtacattttgtataactgggccagcaagcaccgccccagttcgctcatcttggtaattgattgtccgcgttatcgctgaatattccggtatccggctgataggtattatgggctcatgcgatggttggacgttcaaccaagtcgttgcagtctgatcgccaaattggtaagtaattagatagcgatgctggcccgcaatatgtgtatcaactgcattcaaccctgataaacgtgtcccagccgcatctgtaatcgtgatcttcagttgcccggttgctagtagatggcgaaaaccagctaaagtatcaatgctcgtaccatccgacttaatcactgcaattaagtaatccaacgggtcatcagtaaccacttgaccaaaaccataattatgctcgttttggctcgtaatcgtctctcgaatagcactgtcaacatcgccatatccatattgtaaaacggccgctgaatcaacattttgattagttgtaaagacagcatgtggtgccacgattttaccagttatcatcgtggtattctgaatacgcatggcatgattgaagttccagactagattcggtgtactactagaaaaaccgccaccaatggttaacgctggtgctgccgtgacgacgttataaataaccacatcatcattattaaaaccagtggtccgaataccactgtgccagtcattcaaatcaatattcacggcataataatggtgtccttgataagagcccaaatcagcagttccagactcaccaatcagcatcttactcaacgtgccaccattagttgccgataaaatggtccctgcagtaactagttgatcataaaagtcactaatattgatctgagcttgactaaattcttgcgcattgattaacgaagaatcaaccgtaacgctcggtaaacctttgattgcaccatttcctgttggccgaggcttcgtaaaatccatatcctgattagctacgggacggtccaccaatccattggtagttgtaaacgtgattgtattgtttgtcactgacaaaccaccgtttatgatggtctcccattcatcatcctggccagaacgaattgtcgcccccgtattgataacgtgcagaccaccactaatcgtagccacattaccatcaaacgaactattcacaatcgtaattcctgtaagtgcaataattcgatacgtggacaaccaatcttggatcaaagcaatcaaagccgcttgcccatgctgtttgacatactgatcaagatagttcttatcggctaagttctttgctgttgtcaaaaacgacgaagcggtgactgtccgttgcttgctcggctgctttgttgcaactggtatgtttattgacttagtgacatttgttttattcaatgcccttttctcaaccctgctgctcatttgatcagttgccgctacagctcggcttgaatttgagttcacaggggtagctgtcgtcacggtactcactgatgactgtgaatgaacagtccccgataaatctgaatcgatcgtcttaccttgaccgcctgagtgttgcgcctcagataaactttcagaatgggccccactgtcagcacctagtgcgctagctgaactggccatatcaatcgcatgatgagtgccagttgagttggctgctggcgcctgatcagaacttgttgcggctgacgcctgattagtactggcacccgcagaagctgctgttgagtcacttgcctgttgatcaacagctgttttatcttgctgtgttgaccgctgttgggcttcactagtcgttggactgaccgcctcaacagtgccagtcgtagcagattgctccgaactagtcctgtcagctgacttgctggactgggcggtcacactgtggcggtcacgagttaccgcagtttttgaaatccgtgctacttctgttaattggtcttgactatccgtttctaactgcaccgaatgactcgacatggtaaccgtctcagcttcacttgcttgagccactgtcggcacaattctccaacctaaaattaaaacactagaaaacaaccaaaccttgggattggttacgcgccatttgccccgtgtatatcgcatagtaatttgcctctgttaattttagtcaaatatcgacatattttgaattttgagacatagtatacctgcttttatgcgagtaaaacgggggtttgtatttacgcgaaaaaggttatctttaaaaatacaagtactaatcagttcgtgtattaagttgtcgaaattctaagggcgtttgaccggtctccttcttgaatcgttttgaaaaatcggcggcatcgtagaaacagagttcagcagcaatggctcgaatggttaaatccgttgccaacaacatatgctcagcttcctgaattttcttggcattgatgtaatcacgaatcgacatatgcatctcttgactaaacgaccgccgcactgactcaggattgcaccgcgcattgacgtgggccaatacctttttcaccgataattgatcatgcaggtgagcattggtatagtacatcacatcgagcgttgactctaaatgtgcgttataagctaatgcgttcggtttggcaattgcggcaaaatcacgaataatctgcacaactagtggctggtaacgttccgtcgtcacgggtaatttaactaaccaacggtgataatcattacgtagcttaacaaattcataaatctcagcatgattttggattccctcaaaagctaagacatcaaccagcgcactgagttgcagctgtttttcctcactcgataatttatttaataaatcgcgcgaacgggtcagatttttcttagcaaattgaatgccttcttcaatctttccggcccggtaaaatcgaataaaatctcgttctaagtaacctaataagatcagccccttggtggttgggtgctgatcattataatcacgcatttgatgtaaatattgtacaaattgtagttctgtccccataatctgtaactcctttacgttattggtcaaaatttgttaacccaaaaataatgctcattttaacagatgtctagcagtaatactatttacatttgccatctgacaatttacaatgctaactaatcccgctgtacactaatgattctaacaaatattttttatttaacaatcaatacacaaaagcggttatccctcgtaatctgggataaccgctttaaagcaatcatttttatgttaaccaattcacataaagtgaaaaaagtatggtcttaattatctaaaagcttatcgttaaattctccgaccagcgctcacattgccattcatgagttatagcaatgatctaaaaaattgttttaaatcttcgcgagttgccggtgataactgtgggtaagcgcaattctcaattgcgccttgtaacgaatacaataattgaatacaagcgtgggggttggccttttttatggcagtaaaagcgactttgctacccgttgactttagctgttcgggtgtcgtaatcgcaacggcttgcaattgtttggctaatgttggcccaatattaggtaatgttgttagtaatgccaccaaattcagatcctttcgattcataatcatagtttaatgtttgataatgagctctgcaataaagttgccctcttcaatacaataattaacaactaattgatctgtagttaattgttcaatactactcaatccataacccaaatgtcctggtttagttgtaaatcgacttttcttgataactgataaatctaccgcttcatgcgttgggatttgatttgtaatcgaaaataccgttgtgtgagcatcccgatttttaacagttagcgccacttgatgattcgctcgggcagcagcatccgtcgcattatccagcaaattacccaaaatccgcactacttttatctgtggaatatccgctaacgtgactttctctaagattgtcaccactaaatgaacgttctgaccgttggctgcctcatattttgcataaatcagaccactgaccgtcggcatatccaagcgactcaaatcactcagtcccgactgacgattaagggttaccctggcaggcattacttccgttgtaaaataacgctttaagccggccatatcattgttctgaataaatgccgacatgctcaaaagaatattctcataatcatgtttaaacaaatgtaaatcacggttatggtggcttaataattcgttgtaatttgagacttgtagcaatagctgcgcatcattcaagtgactgtttttattactaattaaatacgacccgataatgccaaacgtcacgatagccgcaattgccatatacgtttgcgcattgactgaccattccatcgcaaaaacatacgcaataatgtaaatagcaaaaaacaaaataactaataagtaatcgctaatattaacacgcgcccgttgcaagaaatcggcggccgacacttgtactaaccagcgatgcgctaacatccctaaaataataatgaccggcagcatcataatcgacgctaaaaagagattaatatccgctgtcgaatgtagacctatcgcttgccgtaataacattggcgatgcagattgggctacggccttggcaatgacacccatgattgcccctactaatcgcttaagcgcattcaaaaaggttgccaccggtaacattaaaatccactgggtgtacaacaaccgagaactcataaaggtggtcacacaaacaatcgggatgatccaaaaataagccagggggacttggggccataagtttgaagccacttcccccaggctcatcgtaatgataaccagacttagccaaatgatggcaatccgccaagtgacatattctctaaaaccaatcattaaaaacaacatttcataaccgccagaaatcaacgacagcgctaaaagtactgctgacacgccaaccacctcatcatattaatacatttgttagttcactttactatatcagaaatacggcttcattaaaccctttactctatattgtaaacataaatttgcattaaactataataaagcccttacaatcttattattaattattcataaaaaaagacattgcaaatcgacatacttttgcaatatcttttaaccacttatattaatttttaaggtgtatcctgtaaggtccaattaatcgtcccactgtaactgtcaatttgcacactaggttggacatccaataaaataccctgactgctcgaccaaccacttgcagcattagtgctcgtcgtacccgcgattttcttgccagaactgactgttaccgaagtattcgtcagcacctgtttgttccccgcgttcagataaatcaggttgccactcatggtccgcgtactggatttcatggcagttgctgtcgcccgcaagtaccactgtgaaccggtcttccgtgtgtcattaacagtgatgttccaagcatttgtcggctgatatagtgtttctttaaacggaatcgtcagggtgccaaacgtcaaacttgctggtaatgtgcccaaactcaacgttccatcccgcatcgtcacagtaattgccttagcatccgacttcagcccagaactgcctttcccataaatattgatcgtggtgctgctaccaacggctaaactactcaacttgctcgctaaactagtctcgtcggccgcgtaagtaattgtgtcagtcgcactatccggatttgtcgcaacgatgccagcttgcttaactaaccaggcgacgaccgcgctatcacttgtcagtgaatctaagtcaccaggatatagatcgactgccgtctttgaactagtaatatttagttttttgagggtcaccgctgcggtcgccgtccccttatcaccggtaatctcatcgacctcagtgacggtgacgttacttaaagtaccgagtgcagtcccaagattcagcgtgtacgttccatcgcttccgaccgtcgtcgtcacaccattaacattactactgatcgtattgccgggtgtcccggttcctttgatcgtcgtatcagtcgaataaagtgtccccgtaattttaggagataatgtctgcgcgttgaaacgccccagctgataggtaccttcctcaccattcactgtgattcggaagccaatatagattggcaactcacttttaatattttgaaaattgaccgataacgtctgcgtctgttttgaagaactaatcataatcgaattgccactgccaagactagtaggtgtagccgtaactaatgtcgccccggtgtagctcccacttgccggaccagccataatatcaaaataagcttttgacatcgagttactagattttaaggtaatcgaacctgtcatcgtcattgtaatttgggtcgtctgcctcgtaattcgaccattatccgcatagttagcggacacattgcctaatgctggatacgcttgcaaaccgttatcaacattactaccaaccgaattaccacccggtacggcctgaaaagcagcattagctttcacgtccgtcatcttgctcgtcaaagtcgcggcgttaccctctaagggcagcaaattcagcaagccgagtataccgaatacaagaattagtaaccattttactcgtctgttacgcattccgttcacccccatcttgccgttttaatattcggtacaacgcgcctgctaaaacactagctaacaactccatcccaccaaggatactgccaatgacaagccgctcactcgtttggggcaattgttgaccattgcgtgattgcccacgcaaccagccatcgataattagttgtcggcggattggcttgcgctctgactgatttctctgaccctgggtacccgggtcagctggtctaataacgtacgggtgaccaccatcaggaatcacacgggcgggaataatccggtcagcactatacttagtctcataaaaccccacactgatctcagtgcgaccgtgtgttgccgcccgcactggtattgcccagctcagcacgagcattacccctaatattaatcgccaccatttattcggcatggtccttcccccatttcactgaccgaactaagcacgccgccgctttttgatccagaaaaagattaatagaccgattaatccaataattaacatgcctaacgctccgaatagaataaaccagccaacgctcattcccgaattatcaacggaagcctgattatacttatctgccgcggccgtactgatgacaaaatctttatcaaacacccatcgatgatcggtatttttagcaactagccggacatgatacgaaccagcctgcaaacgattggtccctgtcaaaattggtactttataaactgagttaggtgctaattgcacattcttctgtgtaaagttcttgatgaccttgccactattcttactcgttaacctagccgtaatcgttagtttggggacgatcaccgcagtaacgttgcgtaattgtggaaacacccctcgccgataattctgcatgcccgccgtaatcgtatcgagcttcaattgtggttgtggcactataccagcagtatatttcagtccaatcacatacgaatactgattggcaatattcatggaacccttaacacttccggtgactttattggcgacccgtttaaaataccaaccgcctaaaatcacaccgttcaccgcttgcttaggcatcgtaaccgtcgccgttaccactttcgacccgtttgcgggtaccgtgatggtcgttggtccctgtattttggtgatttggtccattcgatacttcaaagaaggatcataacttttagttggtgtcacgtactcgataatgccattgccgttcgtataagccgtatgaatcgccgtttgaaccttgatgtcagcgttggtgacgttataaatcgtcgtctgaatctgttgctgtcggccacgcgtcatttttaaatcaaaataggaattatgttgatcaatctgattattcggaatcttcgcggccacgctaaacccgatgtcattgctttgcgtggttttactgctactgctacttgcgctactggctgccaatccactaacgctgctaacttgcagacctaaaattaacgtccccacaatgaccatgattcgcttcaataattgcatcttctcgcccccattactcacatatgtacttggggcgccgttcgcccagatgacgcttaatttgttggtaaatcactcaatgtccaattcaggttagcgctataggcctgcgccttaaccgtattagccttaatattcagtgtcaacgcctttggatctaagcgactaacagttaccccggaaccaccgcccttatcggcatttaagacggcacttgatcccaccgtaccatttaaagcaacttcggaagccgtggcaaccgcaccattggcctccgagccgctgttgaccacgtcaccttttggtaaactgagcgttgcgccctttgcagccgtaccatccgttcctgttaaattggagccggtaaccgttaatttccagccggcattggttccccgaacatcagaaacttctacaaccatcttatcctgccatagcaaagtatatgaactagttgggtcaaccttatattgttgatcatttaaaacgtccagctcatgcgtcccgtatcctaacgatttagacacaaaaatcagcgacaggtcgccacctgctgccgccccgttgtcaccatcgccatcagtacttggcacatcaggatttgatggatcaactggcgtcaccgtggacgtactcttcgtaaattccgctttgatatccgtattcccactacgattttctgcagcattggcaacaatcggtgtactacccgctaataataaagttcctgccattaataagtgtcctaacattggcttcatggtataaatccccctttttcatttaccagcgcttgtttagctttcatcaactaagaacggtggtcattatcaacaatgattgctctcataacaattcataaattactggcactaaatcacttgtgacctcccccaataaccttgtacgattgattaattaatttaaatgccgactcctttgaccacattttcattatattggttggtcagtaacagcgctaataatgtataacgttaactatatttacaaacccggattgttcgtgtaaccgttatcaagcgtgggttgcttgagataattaggcgaacttcctttaaagccgttcaccaacaatcgatggctatccgaataaataaattcatatcaacaatctagggactgtctgaaaactnnnnnnnnnntttaagacggaccctagtataggtagtaaattaattatttttctgccattgcttctggtgctgcaccacaaaaagtccaacccttgctgacaagtgttggactttcgtcatcgatattcttttcaagtctgcgtattaccacggaggaatgccattaacattagtaaagatcgccgtatcgatcacctttcggattgttagcacgccggtcctttcacagataatattggtcgcaactttagacgcgcgggagccgactgtccagtcctcctgccaagtaatcactttaaatcaccaaaattacaatactattgttgacatagtattactgattaattaatcaggctttcaatcgttatgctgaatcaactcggtaataacacaaagcgctggtgatgatccgtgcctgcttccaattgagcgtgacactgagcggcatccttaaaatatcgctggctgacctgatcatccaatagcagtccggcgctaaaagctcggtttaaacgactggccgcttgtgctaactggtcaaccgttgcatggctaatcacaaaaccagtgattcgttgttgagacatgtaaaactggcgaacagggaactcaaattggttatcctgcggtgccgtaatcaatgtcacctgaccacctaatcgtaataacgctaaattaatcgccagtggtacgcgtcccgaggtatcaatcacatggtcaaaagtccactgatccgtcgttaactggtccgcaaaccccgcgtgataatcataacaggcggtactgcctagctgctgacaccgtgcaaaatctcgtggtgatgcggttatcacagccgtcacgcccatttgatgcgcaagttgaatcagcttgcggccaacgttgcccgcggcaccttcaattaggagtgtctggccgcgacgaatttccatgacgtcgttaagtacgatggcggctgttgcagctgaatggaccgccgcgacgagtggcatgggcgccacgccatcaggaacgtgatacaagcgatcagttggcaccgccacatactcggctgttgcgcccattcggccttcatagcccattgagttcgtccagacttggtcaccgatttgaaagtccggttgtgaactggctacgacctcaccgactaaatcacgtcccgccacgtgtggtgctgccagggccgtcttaaacgccccactccgaacaaacgtatcaacatgattaacggccaccgccatgaccttcactaagacggtcgcagttgtcgccaccggccgttgcacgtcagcaatgcgcaatacatcgggactaccaaaatcgtcaaaaataactgccttcattattatgccttcttcatatcgcaattaacaagttaggttgtcggctgggacgccctgttcaaaagcagctaaaacttccgctcctttagcgatttgaacggcattgtccagcatatgggcattgtccttaatagcgatccgcccctgatcgtaatccatcttaataccatcgttaaagaaaatgagatcgtatgtggaggtccaaagcgcgaggctttgattattcaccaccgttacgttgtattccgggtccggctgatcaagtacgattatcgtaaatttagttccaatactgcaagcacctccgtgcaaagagtatttgccaccaccatcatccgtcaccaaaaccaattgcttcttatcaaagcccttcgtaaccaataaagctttcagccgattactaatctctatttgcgtcatactatcagcatctcttaattataattttatatgagttataatatatttaaattatattcgtgcttcacgcccaatgccagtcaaaagttttcgcattaattcgacgccactcgatatcggagaacggttttcagtttatcaggtgccacccgccgtgcatcggataaataaatttctcgatgaatcttgctagtacgatgcatcccctgattggcgaccagttcatctatcttggcaaaactcgcgggttcatcgtcataagcacccacgtgcagaatctgtgccacttgcattgcgtcgaactgctgcacgttaatttgttcagttggcagttgtttcttagctttaaccgctgccaaagccggtgcaatcagttcagtgggaacaaagtctgggacccgaatcataatgtcataactgaactcatctttgtcaagatggtcaaattgctgtcccttagtcgtcagtgaccagaccccttcaagcggaaaaacaacgtaatcatcaaattcacacgcctgtgtttgcgcatactgcttatacgcatgcttgagcccataagcagctggatataacgtttgcaggtgcgtctgaaactctgggccattgggattccccgttccatggatactcataaaagtttgggctggaatcgtcaacagttggggttgcttcttagtagcataggttgttttttcttgtttacgccattcatacttcatcttcattcacgtcctttaagttaactacactttcattatacttagaaacaagccgctgcgcattgcctgcaaaaagataatgattaagttagcaaaggtaaatttatattcattgccaccgaacccacaaaaaagactcggccaacctgaccgagtccgtttataacagtactaatggctatgaatttatgatttatctttaagccgttcttctaatcgcttgatctttagctgcttgcgatgaatgtaccaagcaatcagtaacaacaagatgactagcagaccgaggctgatccacaacccccagttagtatgatgttcaatcacggcggttttgttgagttggttcgcacgatcacgcgtgatttcaaaatctttggtgaacgtccaatgttgctttttggacgtcacggccaacttagcggtatattggccgggtttcaacgcatcccggccaacccgtaacggtaaggcataaactgaattaggcgccatttgaccgtgttcattgacctgcttgtagcgcactttgttactaccacgacgatagatttggacatcagttttgacttgattcaagaaagcggccgttcgattttgtaggggtaaactaatttggttatacccgttattttgcgtcgcatcaaccttacccaatgtcaacttgttcttggtgagcgcgtggtcaccatgcaatacgaccgccactgagtaagcgtattgattcttaatcgccattgcgctcttactctgttgtttggcggccttttttaagaaactcagtccaccaacgacaacaccatcatacttctgagccggcattttcaccttaaaagtcacgatcttactggttcccttagcaagggtaatcttattcgccgccgtcgtaatcagttgactagcatcagctggcaaatcaatgttcttgccatcagccgttgcctgatactcaaccaccccatcgggattagttgtcgccggtacaattgccgtatgcacggtgatttcctggatacttgtgttcgtcactttcactgccaaagtggttgtttggctaggctttagtttcagatcatagtatgaaacagccttatcgatttgatatttggaagccaccggtgcgacctcaaaaccgactgtgttagccgaacccgttcgtccccagcttagactaactaatccgactagcaaaccaattcctaactgccaccatctctttgttaacatcatttctccccctaatcatgattcggaaaaatgacattaacccctactagccattatttttccgatcaatacttattagctattcgctggtgcagtattcaagctccaagttaacgttgtactataacttcccgtagctcgtgccgtagtcttgggaaccattagttgtgacttagcaatatcagccacgttcttaccattccccttacccacagcggcggtcatcaaaaccttgtcactattgagtgtatctagcgcaacaccggtattggccgttgcgtccgcaccagtcgtcgatgcatttgaatccaaaacaccattcaatgttagaatcgcacccgtcaattctttattagcaaccgctttgtcgtttttaaaaacgtcattttgcttcacacgtaaatcccaaccagcagccgttccccgtaagtccacaacggataccgccgctgacttattcgtgttgtcatagttatcgtctttgttagctgcggtgatttggttggtaccaaagtcaagactagcaccagctaagtccgtatcaccattatcaatagtgatgtcgcccccagtgaaaccaactgtcccattagacgtttgtggcgtatcggccgcactcgcggtcaaacctgatgttgcaatcaatgctactgagaataaaagtcctaataatgtttttttcatgataatgaactccttttttttagatagttaaccaattgccaaccaattaaaacgaccaataacccaataccaccaatgaaagcactcagccaccattgttcactcgtttgtggtaaccaccccgggttctgatgatgaacagcttgactagcattcggctgatgcacaatcgaatgactcgactttgacgcttcagtcacctgtaactgattagcgccagtgtctgagttcgatgactcagcctggccgtcgaaacgaatcgttgctgggctttcagccgtactagccacaccaataatcggtgctgacaaccacccccaacaaagtagggtactgatggcaattgtgatgaaccccaaacgcttcatcaacaccactcctcctctatatcattatttgcggcataactaaaaccaaccctggccgaaaccaatcattaagctagaatagttattgtggtacattgtaaatatatataactaacttactaacaacaatcaagcagtcttacaaatcttatgttacctaatcattatttttttcatcatcgattaggaaccccttgattaagcgtccaagtgaccgtcgcctgatacgtatccgtcaaggcacgatcggttggcacttgtaacgatagtgccccaagtgccgttttctgaccaaggatattgacgccttggttcgaaacagtttgatggttattgacgatcaaccgtgccacacctggcgtaagaattgactcgccacccgtttgttgatccttataactgagcacagccgctaatggtcgtgccgactgcttactagtgaagcctgatgctgagagcgttgcattgagcgaccacgttgaacctattgaccggccatcttgaataactagcccagtatcataggaggcaccgtaactttctgatttaccagtaatcggattctgaccaaaattaatggcctgtggtgctgaggcaaacattagtcctccaggactgtacattaatgtaatcgtttcatctttgtcggtaaaattcccttgaaccccatctggtttatctggcacgtacccttcaatctcaattggtttaatatgataggcatcaccagttgcaccactgattttcgtgtcgggtgccaaggacttgccagcagcgtccacatacttcactgtaatcgtgttgccagtggcccattcgaattctccaacaatggttttaccatcgtatttagtcatcaaatcagccgaagtataaacttttttattatttaaactacgccatttcccaatataaggtgcctcactactaggatttggcaagtgccaactttcactcttaaaaaagttaaagctgggtcccaacaatagacgtttaggcggcaacttcgaactgaaagcgttggtataagtttgcgcactgttggtattccagccagtcaaatctaatttgtctagactggtattttggaaaactgattcaaagttagtcactttggtcgtattccaagcacctaaactcaaggtttgtaaacccgaatcttccgcaaatagctgtgaaaaatccgtggctgaacttgtattccagttttcaatgggcagactagttaactgggggttgccataaaacacttgtcccatgtcaacgaccttcgccgtatcccacttaccaactggcagattcttaacttggctaactttggtaaagattcccctcattgtcgtcacattaccagtctgccaattatctactggcaatgccgtgacactactcatttcagaaaaagtccccgccatattttgtacattcttcgtattccacttactaatcgggagactctttaactgactaactctagaaaaagttccggccatattcgtgacagtaccagtctgccaattatctactggtaacgaggtgagactagtcatgccctcaaaagtataaccaagattggtggcactctgggtgttccaattcgcaaccggtgcagttgttaaactggcacagccactgaaggttgaattaaaatcaaagactttgccgacattccagttatcaatcggcagctgggtcaagttagtatcgccataaaacgtgctccgtatcgtttgaacgttacttgtattccagttgtcgagtggcagggacttgatattaggtagcttagcaaaagtcccatctaacgccgtggcccgactcgtatcccaattagcgacgttaatactttccaagctagtatcacctgaaaagactaactgcatattaaccacgcgtcccgtttgccacttatcaatgggtaaactcttaaccttcgacattcctctaaaaatcgcggacatgttcgttacgacacgggtgtcccaattagcgatgtctaatgacgtcagcgaagaacaatccgtaaatgttcgcatcatcgtcgccactttactggtattccacttgccaactggtaacgacgttaatgaactgtcaccattgaaagtgtcaattagatactgtaatgaatccgtgttccaattggcaacattcaacgtaactaacttggtacaattttgaaacgttccctccattctgatgacgctgctgacatcccaactattcaagtccaacgcgcctaactgtgaacagttcaaaaatagccacgaaatatccgttacgccagttaaattaaggttggctagcccatcaatcgccgtaacattaggtaagttagcaaacagatatgaataattagtcatagtagttgccgttatcttaccgtcgatgacgatctttgaaacttgggtcggttgatagccgttagccgtcaaggtttttacaatccaactccccgtggctgaccctagcgatgcaccaaatgacccaccactcaaatgcaatgtgccattagtatctaaggtcattttaaccgtcccattgaccatttctgccgctttggtcgtcgccgtttctgatgtttgattatttttagcgttttccagtattgtactgccactactgatgccactactgatgccactactgataccactactgataccactgctactggtactactgcctgatgttaaattcgactgcttgtcaggtcctgcactttcctgggcctcaggtgacacttgtagtgccgagttgtttgcctcatcttgcaacgtcaatttcgaagcagaaaaaacactgctagtcgatggcattttctgatcaacactcaattgtgcgcggggaaccgcccgaataactgcccgtgatccacgatatccgaccacaactagtgctaatgccagtcctaggccgccccgataccataattgccggtgttgcatgcccatcgctcccttcacatagatagtattttaacatctcttgacgttaattatcttacattattttcagtttgtgacgttcagaaaaagacttacaattttacagatatccgaatattaaatttttatcaccgtgatattatttgtgttaataaccgtaattaaatgataagtatcagctaacgaacacccattttcatttacttgtttattcagtattcttcatggatacaactgcacgatggtcatttttgaagtgactcacgaccaagtcatttttcgagcgaactagatgacttaccaacgctgtagtgccttttccatcatggtcactatgaacagcccaaattggccaatttatatgcgctcacctaacctgctaatgacgataagctatctgcgttttttcaattattttaatattcactaggccacgttcaatctaattgatcagcaagcaacaaaaaaacaattccccaaaataccgaggaattgttcgtacttaagatatttaacgacccgtcacttcttggtaaacgtccaaacagctgctggggcattgccaaccttaactttaacgatctgatttttagcattaacgaccgtaaacttattagttgctgtatagcgtaaatatagggtcttagtagtcgagcctgacttatagctgactttccagaacgttggcgtcttggcagtcatgctataactcgcatacgagaccagctttttaacttgtttgccattcttataaagcgtctgattaaatccattcttagcgctaaacgttaagatttgggagtacttgttagtcgtattcgacttccaagtacccgctggcgcgttgactttaaacgatttagtcgtcttcttggatgacgaagtggccgccgtcgatttagttgccactttcttagtcgtggttgtcttgttagtcgtcttcttagttgaagaggcagtagttttggcagtctgaacacggatgacgcggtagaaataagccttagtcgttggattcgtggcgtacacataaacattgctttgcgccttcaatgtcttggctaatttaaccgtgtactttcccgtcgttttagaggccgttgcagttccaagatttttcttggcgttggccgtactttttacggtgatcttagcgcccttggttgccgtacctgtaatttgcgtcgtattattgtaaattgcattgaccttcaaacttggtgcgacattcttcgtagccgttgtcttcttagtcgccgcattcgctgtaatccctgtaacgggtaccgctgctcccagcgttgccaccatggctaaaccagttacagcaatcatcaatttcttcattgatcaagactccttcgttccactggctaacttgtcagcgatttatttacgcctcgtagtatagcagtttttctatcggacaaccgctccttattaataatttaataatctttatgctttaattacaactgaatcttatcgaactgattttaaatgcgttatcacatccgttaacgacggtacaatcgcagtcgcctgatcagcatagggctggttaggccgtttcatatccggcacacaaattaccggaatcttcgcggacgtcgccgcttgaatgccagcttcactgtcttccagaaccaaacaatctgcaggttgttgttggagtttggcgcacgccatcaaaaatatatctggatatggcttaccacgatcgacatccggtccgaaggtaaactggtcgaaatattgcgccacatcatgggacgtcaaaatgtctaatgcccgcgacttgatactagatgaagctaaggccactgaataatgattccggtgtaaaaactgtaacaacacccgtgctcccggtttgagctcaacgccatcctgcataaacgtcttttccaacgctaacgcccgctttaatccagtatcaacattaaacggcaagtcaaaacgttcaatcaagtgttgcatattcgtcaccgccgacttaccactgtattcctgtgcataagtcgccatggaaagcgtctgcccataatcctgtacgattcgttgatacatctttaatgaaataacctcgctatcaatcaataatccatctaaatcaaaaataactgccttcgtcatactcaccaactccagtctatttatcgtcaataatctaagcttatcataactgtttaaaaatgtaagcggagtcatcgctactaatattaagtttcaaaactaaatctggttagtacagaatttgtgcgaatttctatatatttagtaagcatagtaaaatacccccgcagttctttagtaacaacccagtgagtttcgcagatgaactcctagccaaatccctacacaatagctagtagcaataagttaactccactgatttgttgtttatttagtcgtcaaccgacccaacattaactccccctaatcaaaaatggtgcgccagaatattttcattcttgacgcaccatttttaatttaaactcattgtctataaatcgtctcgatgtaacaaggcaatctcttcacccgcagctcggcggcgatcaatattatcctcaccccacacgcacagctcatgtaagacaacggacaaactccggccataatcacttagtccgtattccacgcgcggtggcacttgttggtacactttgcgcgtcacaatattagcggcttccaactctctaagttgttgtactaacattttctgcgagatttgtggaatcgcccgttccaattcgctcgtccgcatcgtctgagtacgcagatggcacagaataattgatttccacttacccccgataatttccattgtggcctcgaccccaatatgataagttttggtttccaataattgtccctccattccatacttactttttagtgggtatcccactttaaagttggtacttgtctaaaagtcacttgctagtataatcattatttatcaacttagcaatagcaggaggcttatcttatgacaaaacagtttaatcccagttggacacttttggcactcgcaatcagtgccttcgccattgggtcaacggaatttattagtgttggtttaatgccactactcgttagcagctttcacatcaacttggcgcaagctgggctgaccgtctcgatctacgccattggtatcatgattggcgcgcccgtcatgacattactcaccggtcggcttaaccgtcaccgcttgatgatgttaattatgattttatttattattggtaacttactcgcagcaagtgccccaacctttggtgtcttacttgcaggccgggtcgtggccgctttggctcacggtatttttatgaccgtcgcctcagtaattgccgctgacgtggtcgcacctgccaaacgggcctcggcgattgccatcatgtttacaggactgactgtcgccacagttactggtgttccgttgggaacgatgattggtcaattaggcggttggcgctggtcctttatctttattagcatgattggtgtcattggtttgttagctgattactggttaattccacgtaatctgccgttacccagtaaagccacggtccgggggattatccgcgtactcactaatccacaactactgttcgccttactcgtcacggcgctgggatacggtggtaccttcgtagtttacacctacctatcaccactactagaacagcagatgcattggtcagcgagcgctgtcgttttgattctagtcgtttacggcttaatggtcgcccttggtaatacactgggtggtcgttgggccaatgcacggcccttaattgcactattcaagatgttcagtgggttactcatcaccttactcattctaagtgtcaccgggtacagtcactggttaggactattgaccgtcctactgatgggaatctttgccttcatgaacgtccctgggctccaactctatattgttcagttagctgaacagaatacaccacacgatattacgatggcctcagcgttaaatatttccgcttttaacgtcggtatcgcactcggctccggtattggtggtcaagtcacgaccaaccttggcttaggctggacaccgatctttggtgccatcatggttgctgttagcttagtcctattgttaggtctaatttggttagcgcggctcgcaaaaagcaccgaccggcattgcgttcaaaattaataactaaatgacccgtagtagtcttaaacggtcatcgaaaacactaagcttagcggcttaacaatgaccgccaattcggttgtcctatcgctaggctgagtgtttttctttatgtcactatcttttaaatccacttaaccgtcactagttcaggaacctcattaggaggcgactcggaatgttagcaatgaatcgtcccgattttcaccggcagccttcctacttttagttgggatttattgtttattttcagtgttatttgaagactaattattgccattttaggctgtcttaattgacttaaagcccgaatatgcccgctttacgccattgcgaccccaatttgttcgtaaaaccgacttacccagcattcgactgggttgcattttcactttcagaaagctataacggtaatatacgattggtttccacttttactgagaaggtcctgattgaatggtcagtattgactattaccactaactatcaagtcagagccagacagaaccaaccaactatgggggcgcaacatgcaacgcaaatcaacattaattttattaactagcatcactttagttatcggcttactggcggtcggcactgtcaaagttgttggtgatgcccacagacctagccaatcaacggtaaccaccaaaaaagtcgtgtcaaagacgaaagccaaaaccacggctaaatcaacggtcatgcgcacaccaatcaactggcgtcaatcatccgaaacagtcgcgtatcccaatgtcaaccgctatccggacttatggattcacgtatcgttggctaaacaacggctatacttgatgaaccatcaccacgttctctatacaatgtatgcatccagtggcgtgccaactgctgaccgcaaaacaccccgtggcacctatcatgtgcaagccgaacggggaaaatatttttatagcgctagtgttgatgaaggtgcctattactgggtctcatggctcaaccatggtgaatatttgttccactccacacccgtagatgcccaaggtcactttatcaaatcagacgctgctgatcttggcaagcgaccgtcttcacacggttgcattcatctgagcgttgcagattccaagtgggtctataacaacatcaagtatggcactaaagtcgtcatcgactaacgaaacaactacaaaaccaccaaaataaatcatccagcaacctatttgtattaagacaatcaggtcgctggatgatttttattctcattggcacgttgaacgagttcttatttagctttaatatgaacagcttaaccgatttcgacttgctcagcaagatgattggccgttacactatccattaacatatcagcttccacgtataacttatgccacatcatgaaggtcagcacggtccacaattgacgcgaattatcacgaatacccgctcgatggtcatccaatagttttaagaaatatgtcttgtcaaaatactgatcggtttgcgacgtcacaataatatttttagcccaatcgtacatctcatctttgagccacaaccgaatcggtactgggaaaccaagctttttgcgatataacacgtgcgcgggtacaatatcttcaaccgcttttcgtaaaatgtacttcgtcgtaccgtggctaattcgcaagttggctggaatttccgctgccagattgaacacctcccgatcaacaaagggtgtccgcaattcaaggctgtgggctaacgctgtccggtccgcattatgcaacaaatccccatttaaccacgtgtgcatatcgataaattgcatcttagagattaaatcataatgcttggcttcatcgtaaaatacccgggttgtctgttggaacgaatggtcacgattgtagtgcttcatgaactgttgcttctcagtttcattgaagataaacgcattgccaacgtatcgcttctctaacggtgtcgtcccccgcataagcaacgaacgaccccgcattcctgctggcatcatcgcggctatccgttgaagggccccgttgattggcttcgtataccgaaaggctttcaaggattcgggttcatgataaatcgtatacccgccaaaaagttcatcagccccttcaccggtgagacaaactttaacgtgcttgacggcttccttagtcaagaaatactgcgggacagcggccggatcagctaacggatcatccatgctccagacaaaatgtggaaaggctgccatgaatgcttccggcgtgatggtcatttggacgttatcgacattcaacttagcagccgtttcctgtgcgacgtctaattcactatagccaggtcgttcaaagcccaccgagatcgtcttgagatttggattgaactgcttggcaatcgccaccacaattgacgaatcaatcccgcccgataagaacgccccaactgggacatcggaacgcatatggatcttaaccgaatcaatcaacgtctccttaagccgtgtcgcgtagtcctgttcagaacggacgactggatgaaactcccgatgataataacgcttgatttgcggcgcgtgtcccaactgttttgttaatgaacagcccggcgccagcatcttgatttcctttgtcagggtctcagtttccggcacatattggaacgtcaaataatcttgtaatgcctcttgatcaaaatgcttatcttttaaaatcttataaatcgccttactctcagacgcatagtaaaaattatccccggcaatcgcataataaaacggtttgattccaaattggtcacgcgccgcgaataacgttttttcctgcttatcccagattacaaaggcaaacattccccgcagataggtcgtcaacttggcctggtatttggcgtacatccctaagatcacttccgaatcggaatccgtcttaaacgtgtagccttcttgaattaactgttcacgtagctcaacgtagttataaatctcaccattaaacgttagccaataacgttcattatcatatgacagcggttgatgaccacccgccaaatcaataatacttaatcggcgaaaccccatcgtgatattatcatccgcaaagtacccctcatcatccgggccccgatgcacaatcattttagtcatttcccgcacaacctgatcatacgcggcattatcaacttttcgccgatccgttaagcacccaaccaatccacacattctattcactcccacacttaagttattacgactaatcaccaatattatcgttagtgaccaatcacaagtcacgctcaaatcacagacaacccatgtccagtacgacgatttgacctgcgaaataatggcaagccaaccttgatcataattaacagccgtacttttggcgaacataacccacttgattcaaactggttgcctctaattataatttagtgtagcccgtcgcaacagccgttttaagacaggcggactaaccattacactacattaagaccttatttggcccattgaagataagttcaaaataaacgcaagcgaattgattggaacggcccagctcaggttcataattcagtacacctgaataagacgtaaaaaaataaccgtttcagggaaatcaaatttctgaaacgattattttaccagttagcaaaccgaatcttgccaatctgaattttactgccgtcaatataaatcgactaagatttcaatcagcgattgtttttgccaatctgccttactaagtagcgactggccgctgcggaacacaggacggtttcaccgttagccatcgttagtcgccgataccgtttatccaatgaccgaatgcgggtcagattaacgacatatgacttatgacaacgataaaaatcagaattcaaatccggcacatcctttaataaaccgtaatattcaagttcaccatcatctaaatgaacgataatcttatgtggactcattgaactttcaaaaaataacacgtgttgcacgtccaacgatcgaatcgtctcgccaattttgatctggatataactattttgatcattgtcttcagctttgaaacgctcctgtgccacgcgtaagacggtatttaatcgctcgtataagcgatccggaaaatccttcaagataaaatccagggcttccacttgatactgaaacaccgtcaatgatagctccgtatgcgtcgtcacaaagataatcttacttcggatgcctaaatcacgaatttgactggcaagctgaatgccattaatatccgaattcaacgcaatatctaaaagaaagacggcttgagttggttgctgacttttgacatgcgctaatatttcatgcggatcggcactcgttaggccaaatcccatatccaattgacgatcaataatcactttactgaccagttgctgcaaggtttgtaactgtttagtatcatcttcacaaatatatactttgatcattttatcattcccgctttaccgttaaacgctgaacaaaggctgaggccaataaccgcgtttccaatatcatattttcatttcgattaacaatggcgctgagctgactcaagcctaagccccgctcttgtcccttagtcgaataccccgcttcctttagctgccataaaggtggcaaggaatcaaaaacgttattttgaactaagaacaccgtactgtgggccgtaacaaaaatggcgctcatcagctcaccataatagtgaccggccgtgacttcaatcgcgttatctaaaataatacctagcgcaattgccaagtctaattcattcgtcgttaccccattaagcacttgcttcaagtcaaattgaactttaactccctgtgattgcgcatagctgagtttgctaaatagaatactcttgaccgatttgacctgaacacgacttaaatcttcgagattatactgctcatccgaaacgcgcttggtcactggggcaatattttgttggtaatattgctgtaagcctgccaaatcatccgttttcaaatactcattaatcgacaacattatattctgataatcatgacgaaaccggcgcaattcattataatgcgtttcgatttcatgcatgtaccgtgtatcatttttgatttgcaggcgttgttgttgaacctggtacttggcccgaatcgtaacccgatactcatcatagatggcaatcgcgagccccataacgaccaacaacacaactaagttactgacgaccattctcaattcactgtcgaggccctcgctgacaataatgtataaatagatggcgagtagcagcaaggccgtaacccggttcagtctgggacgattgaacgtcgtctggatatgcgtattcattaaaatcagattcaatgtgattaaaccaaccagctgtaatcccataaaaatcaaaagatacccgtcatctaatttcaacatatacgttaaaagtgaactgatatgatcgacgacaattgaccagataatcacctgtaggctaacaaataatgactcactgaagctatgtgtatgccaccaagtaaacagcaccaccagtcccaataatggcaatgctgcatattgcccgatcactgaaaaaatccagccgctgactaggctactgatcaccgcataactgatatcccaaatactaagtacccgccaatcacgcaaaagcaccttaacgaacaagaatatgaacagcgtttgcacaaaaataatcttcatcagctgccccacagctccagtctactcatcattaacaccactattttgccggcacacctattttgattatgactaatcaatacaaccggtaccttcgtttcactgaatctttttgcccactgtaccatcaaagtcccccttacatattggttgttcaaactggtacctacagtttaaaacactcaccaatacttgaaaagaatacacaatgaaccgaattattcaaccagcctttaagatactaaatcatcatttcaagacgactagtcgctacatgaacgcaaaaaaagacgcgacctaattgatatccactcgtgcctatcaattaagtcgcgtcttttgtcattaaacctcctaatcttgtttcatcgcgtcccaaatcatttggaaaatatcatcaaatgtatattggtcctgagcataccgtcctttactgatattcgtcgtatgcgtatgaatagttgaaaacacgacccccatatgcaaactaaccggtaactgcttaatcaccttagcatcgatagccgccgttaataagttagcgacaatattattcggatcggcatctgccgccgaaatcgtcatcccctgtccattcaatgccttgatctgttgaatgatcgtcaagctatctggattggctaacgaatagtcatacacctgctgtacatataatcgaatccgagtcgtcacatcgattgttgaatcacttaatcggtctaagtcggtagtactaagaattcggttcgtctcgcgcgcatagacactatcgatcagagcctgtttattcttaaagtagagataaacattggattgtgcaatgccaacgtgcttagccaccttagtcgttgaaaccccggctggaccctcagcgagaatgatagccgcaaccgcatcttgaatcttaacttgtttgttcatatcttttctcttcatgtcttcagtataaaagataaaaatatctttttcaagcttgacaaagatagaattatcttttatgatagtaaccgttgaaagatagttttatcttttaaaataaaaatcaaactttaaagaggttctatggtagattgcaaatttaannnnnnnnnnttaattttacaatctaccctataattatgaaaattgcaatgttaggttcattaggaaacatcaatcggatcgttgtccctaagctcgtccaagccggtcatgacgtcaccgttatctcaactagtcctaagcgccaagcttcaattgaagctgtcggcgcccatgccgccattggcacaatgactgatgttgatttcttatccaccactttttctggcaaagatgtggtttacctcatgctttctggtggtatcggtgatgatcccttcgaaggggccgtggctcaggctaaaatttggaaacaggcaattgaaaatgccggcgtcaccaacgtcgtcaacctcagtagcatcggcgcggatgccgatgaagtggctggctcgctacatgcttacaacttaattgaacatgaattacgacaacttgacggggttaacctggcttttgtccgtccaactggattttatgctaacttgttcggtaacttagcaacaatcaaggctgaacataaaatttattccagcacgcctgctgcttcagcacaaaaatacgttgcgcccgaggacattgccagtgtcgtttatcccctaatcgatcacacgccagccggtatcaccgtccagtatgccttcagtgatacgttcaccggtgaccaattcgttgctgatctgcgcgacgccttaaacatgcccgatctacaatgggtacaaatctcagatgaacaatatcaagctaacttgacgaaccacggtgttcccgttaaaattgccgcttcattagtccaaactagtcgttatcagcgcgaacctgaaggactttatgcagacctaaatgcttctgacactagcgctggtcaagtcaaattagctgactttgtccgtacttttgtggtagcgtacaatagtgaaggcggttaccagtcccatacaatcgcagattaaccgtttacaatacctgaacatttataggaggagtttactatggcttatcaaacaattaatccatataccaatgaagttgtcaaaacttacgacaacgcaaccactgaccaaatcgaacaggccttaactaccggcgacgccctttatcaccaatggcgtcatgaacccgttagttcccgtgcagccagcctccataagattgccgcactgttacgtgaacataaagatgaattagctaaaattgcaacaatcgacatgggtaaattactgagtgaatctcaaggtgaagtcgaactatgcgccatgattgctgattactatgctgatcacggtgctgaattattggcaccgaccccaatcagcactcaagcaacgggtgatgccgaaattgaaaaacaagcaaccggtgtcctgatgttggtcgaaccttggaacttcccatactaccaaatcatgcgggtcttcgcaccgaactacatggtcggtaatccaatgattttaaagcacgcctctaatacaccgggatcggctgcggccttcgccaagattgtcgaagaagctggtgctcccgctggtagtctaacaaacctcttcttaaactatgatcaagttagcgatattattgccgacccccgcatccagggcgtcgcactgactggttctaagcgtggtggacaagcggttgccaaagcggccggtgcaaacttgaagaagagttctatggaattaggtggttcggacgctttcgtcgtcttagcggatgctgatattgacgaagcagtcaacttagcatggcgggtccggttatacaacgctgggcaagtctgcacctcatcaaaacgctttattgtcgctgcggatgtgtacgatgatttcttagcaaagttgaaggaacgttttgccaaattagtccctggcgatcctatggacccacaaactaccctggcaccgatgaattccaaacgcgctaaggaaaagctacaagaccaagttgaccgggccattgccggtggtgcaaccgttgcttatggcaacgaaccaatcgacttacctggccaattcttccaaccaaccatcttaacggacatcgatcaagacaaccccctcttttacgaagaaatgttcggtccagttgcccaagtcttcaaagttgattctgaacaagcagctatcgatttagccaacaactctgaactgggcttaggtggcatcgtcttcgccggaactgcggcgcatggcaaagcggttgcccaacaaattgaaactgggatggtcttcgttaacaccttcctcagttccttaccagaactaccatttggtggcgtcaagggctccggctacggtcgcgagttaagcagcctgggcttaatggcctttgttaacgaaaaactggttgtcactgctcagaaacctgactacgacaacggtgctggcggcttagttgttttataaacattagcccctcactacaacaccgattacacgtgcttgaatacgaagcatgtttcaaacttttagtgtcaaaagctaccagcttaggcccactgaaagaagttcgaatcagtataaactttttgtcaagtgcgtctatgccgacttttgtcaaaataagatgaacaggccactaactcaatcacacaacaaaacaggctttgaaatcgcgtcgcttgacgtgatctcaaagcctgttttgttattgcactagtaattggtaactaattgttagccaatcttagcaacgtaatggtaagcaccagagttagataagtacttcagccattgatagccatccgcagaaaccgttccaatataataaacggattcgcccgcggagtattggccaacaactgaggcatttagactagcagcggtccgaatattcgttgtggtcttaaatgtgtacgtaccagcagccgccgtcgtcttacttgctgaagatgacgtggtcgttgcggcaccgccactgaccttaacgtagtgttgcgcaccactgtaactcgtgtaacgtaaccaagtttgaccgttagtcgttaccttggcgttgtagttgaccgtattgcctttgtagtaagtcccaacagttgaagcggcatcacttgctgaagacttgatggcagtcgtcttagcaaacttgtaagtcccgctttgcgcaactgtcttagcactagccgtagccgttgacttgcttgacgtcgtcgttgttgtggctgcaccactaaacttaacgtagtgttgcgcaccactgtaactcaagtaacgaagccaagtttggccgttcttagtgactttggcgttgtaataaaccgtatcacccttgtagtaagtccctaaagtcttggctgaatcattaactgaacccttgatggccgtggtgccagtaaacttgtaagtcccagtttcagccttagtgaccgtcttgctagaactagtggctggcttggtggtagtcgttgacgtagctgcaccactgatcttaacgtagtgttgcgcaccactgtaactcaggtaacggagccaagtttcaccattcttagtaaccttggcattgtaataaaccgtgtcacctttgtagtaagtccctaaagtcttagctgagtcactaactgaacccttgatagctgtcgttttagtaaacttgtaagtgccagtttcattcttggtaaccgtcttgctagtgcttgcggctggcttagtcgtggtcgttttagctgcggcaatcttaacaaaatgttcgctaccactgtaacttaagtaacgtaaccaagtttcaccattagttgtaatttcagcattatagtaaacgcggttacccttgctataagttccaactgttttagcactatcactggcagcgctcttgatggctgtgttcttggtaaaggtataccaaccagaggccttcttagtcgttgaactagttgacgtattagtcgtggcactagtgtcagtcgttacttcactagtcgtcgtatcattgctactagttgtcgttacgaatgtattggtcccggcactatcttcagttaaaccattgtaatcgatgctgacatcaatgtaaccggtataatctgaaccagatggtaagagtgccgtatcggagaattgccatgcaccatcattggtgttccaaaggttattagcagaaggtgtgtatgggtattgggcccgccatacacgtgattggccaactgtcttaacaacagcatctcgatataagtatgagttggacgtataaacgccgtgattcttgtaaccaaaggaatctaacgttgaccagaacgcgttcaagttcgccgttgcgttaactgagtatgaagatgaatcttccatgtcagcgaacaagagaactttggttgaaacattgttcttaactaagaaaccagccatgttagtcgcttcagatttagccgcatcagccgtgctaaacgttgcatagtggtagaaatcaacgtttaagccagctttattagccatctttgcttggttcagtgcagctgggttcgtgtaatcagtgccttcagtcgacttaacgatgaccgtcttaacacccgcagcctttaacttattgaaatcagattgcgtcatggtactttgatatgacgccacgtcaacaacatcaacgcgtggccgagtcgtatccccaatcgtccagacatccgttgaagacgtcgttgctgcggtataagcaacggcagcaactttagctgtggctttagtagcggtcgttgccgcgctacttaccgtacttgaagcgggcgtaacagctttgaccgttgcggtacttgaagcagcactggcggcagtactgcttgcggtacgacttacttgagtagtggttgccgtactagaagtgacactggttgcttggcttgtagcctttgcagaagtactagtggctgcactcgaagccgacttagttgcttgactagtcgagctagatgctgtactggtcgattggctagtggccgcactcgacgatgccgtcgctgcttgactggtcgtcttagttgttgccgcactcgttacctgagtcgcagcacttgacgaaactgaggtcgctttagtcgtcgcatcgctagcagcagagctcgttgcaacacttgcactagaggccgtgcttgcagctgaagacgatgttgtcgtcgcagtcgtaacatcagcgtgcacgtttgtattgttaagaacggaacctcctaaaaatgagaagaaagttaatccagcaaccagccaaagtttccccgacttataaagcttgaatctttccgactgacttgcatcaattggattttgtgatttaaaattcatgtgaacacccttttttaatttacttaaagcagtttaattataagcggttgattgccccgctcgcaaggggatttagtataataattgtacttttggtagattgcaaatttaatcnnnnnnnnnnttacaatctaccataaatatataattctcctcataatacaaacgcaattttctcctgaatttaaaaacttgcttcatatttttcttccaaatattctattagattcattctccgtgttatcaaattaagaaatcttcataagggggctattctagatactatctatgcgtattccagttgccactttatatttaagaaattacaagtttgatttaagcacaccctcatttttttaatggtctaattttgttaaaaacaagcaaccattgtctcgattgctcgctattacagttccataatactcttttaaccgccattttttggcacttagagttagacaaatggtagattgtaaaattgatccgaaagctgctcggacaaaaaaggatcagcttcccttaaaatggtgaagtgagccccatagattggagtgaatctcttgataattaattttatcacgatatctccaggtctactcacgttggttccacaaatctagtcacttaactaaaaaaatcactattgactcttcttgcataaaagcataggccaataaaaagaacccatcatcagctactgcgaccaactaggatggtcttcataaatcaattttggacaggccttgattactatcattctcatcacgataaatatgacgttctttcatgcaatatgtgctgaaaactaacgtaagtgcctttagaaccttgccttctaaactaacccgtaatccacaccattcacgttgcgttacttcattaattaattcactaatatttcaacccaatccttatacaccttttatctgaatactgttcatgttcactattaaaactttattcattaatacaattaacataataccaactaacaacttctgatgaggtattggaggataccttttattttactcaagacaggataaattatacgtttaatcctaacgtccaaagagcacccctataagatagcggagtactctgaaaaatcagtaaataaccaattaattacttgatagattgtagattcaatccgaaccaagttattcaaatgcctatctagtggcactacaacagtgtataataaaattggtaagtatacgaactacggtgttcaaaatgatgcagaaatcatccacaaatatcgtgttgcgttttttagctgtggacctttctaaaaatggtgattaaactgattaaattggcaccatgaattagttaggcttgctattttatcaatctacattggagtagtgaggaaaacgttatgaaatattgtccacattgtggcaattcggtgcgggagaaagctaatttttgtccaagttgcggtaatgctctggttgaaactagccatgcacaatcagtatcagatagtaacaatcaatttaaagaaatttacaataatgcaacggctaagttgaatcattatacaggtgaagagggcgccgttaaggttaacattgtagctttattctcagaagtcttcaaacaccacactaaagatgaggccaattctatttttattgcagggactaagacgactacacctgctttgtcggatgtttcagatgaatgggcaaagccatggttattttcgcgaattctgttaggatttttactcgcatttgtggtgttgctatatatggtagatggtttcagtaacagcaatgcgattcccggattgatcctggtgggagcctttgcagtcccgttttcaggcctagtatttttctttgaatctaatgcttttaaagatattagtctttttgaagtggttaaggtgttctttattggcggaattttttcaatggtcgttacattgtttttataccaatttgtcacttttagctcgactagtcagatttttggggttttgacactcaaggattctttatcaattggaatagttgaagagcttgggaaagtcttaattatatcttattttatcagccaattagatgtgcaccatgtgttagatggcattctgattggcgcggcagttggttctggctttgctgcatttgaaacggctggatacatttatagggcaaatgctcaactagttgcagtggcaatcttgcgtggctggtcggccgttggtggtcatttggtatgggcagccatcactggcggagcaattatgattgtgaaacgtgaccatccgtttaagtttagtcagttgttagatacacgctttcttgtatttttcgtcttagcagtattgatgcacgctgcgtgggactggaacattaccatattgggcagtaattatctcaagttaattttattgattgggctagcttggatcgtggtatttgtgttgatgaatgcgggtctaaaggaaatttcgcatttgaaacaacaatcacattcttaaaatgaaataagttttgatggtagatcacaaattcaactcgaattttttgcccaattaaacactctaacccgataagatgtttagtctcctatgatgtaattataattatcagaaaattgttcaatataacgtattaaaagagccgattaactcaaaaaataacgcccatcatctagccatttaactaagatgatgggcgttaatactaatactaatcattactaacagcgtgattctcatccaacatatattgaaagacaatatcaccacttaataaatcaattttaaacagaccttgattactattattttcatcactcatcactacaaaatatgatgctccttcgtctactacgtgctgaaaactaacgtaagtgcccttaaaaccttgtttgcgaaactggttaataatccgcaccatctcgcgttgcgttacttcattagttgcttcactcattttttacacctgatccttatgcattatttatctgaatactattcatgtctgatataaagttccagccattgatacaattaacaaaatgtcaattggcctctcttatgggagctaagggggaattgggggatcccttttaaattactcaaggcagtaaattattttctgctttttaatttctattttctagatagtgtccatttagcgtccactacccctaattcattaatttaacttatcatcagtcattagcgaagaatcccaaagccttcaagcaatctttcaccaagtttgattataatttaattcatcaaaatattctgattggtctactgctttagtcggcccaattcatcctcaattaactgcgtggcaattccgaacgccttcaagcgtcgctttgccaaagttagctgggacttatagcgctccggccgttccttagcttcaaaggtcttgataactccctgaatcttatgcacggtggaatcaatttggcgtttagcttccaataattcagcttcatcatacatcgtaaaagtccttctttgaaagcagtcataaaacctaaagcttagttttcatgatcataaacagcgtccgtttagcgtccatttgtcaccaaatgccaacatcatcagacgttatcggacctcagcgcccaaaaaagcactcccctgagacagcggagtgctccaaaaaaactagtaaataactattaaattatttgcctaacttttccttgccaagaacctttaacttttcatcaaagtcatagacaactggttcaccagtagccatttcaaggtccatgatatcatcatcactgatttgttcgatgtacttgcttaaggcacgtaatgagttaccgtgggcagcaatgattacattcttaccgtctaataacttaggtgcgatttggtcttcccagaaaggcataacgcgttccaaggtaaccttcaagttttcgccaccagggacgatgttagggtctaagtcagcgtaacgacgatcgttaacggctgaaccttcatcatcggcactcaataatggaggtaaaacatcataagaacgacgccagatatgaacttggtcgtcaccgtatttttcagcggtttccttcttgttcaatccttgtaatgcaccataatgacgttcgtttaaacgccaagtcttggtttctggaatccagagttggtcggattcttcaagcacatagtgcaaagtcttgatggcacgagtcaaaactgaagtaaaggcgtaatcgaattctaagcctgcttctttaactttttgaccagcagccttagcttcttcaacacccttttcgcttaaatcaacgtcaacccaaccagtaaattggttagataagttccattcactttgaccgtgacgaatcaatactaattttgccatagcagttaatgacctctttcttaagttatttactcaccctattttacactgaaaaagcgaaaaatcaaaacaatatcagcgcttattttcagaatccgggtggaaagtaatcgtttttttcagattaatgttaggtcgcggccggtgaaccggtttcacgccgatgatgtccaaaataaagttaaaaatcggtacaccgacgatcaatccccagacaccaaacagacgctcactcactagcaatacgacaaacgtataaaaaatgggcagctccgtgcgactcgacataaacttgggattcaagacataggcttctagggcgtgcacaaccaaaatcattaagagcatatagaccacgtagcgcaacccaccaaccgaataggcaatcaagctcagcggtacgactgaaatgatcaccccagcgactggaatcagacttaaaataaagatcattaatcccaagctaatcagttgaggcatcttcaagattgccatgaaggtcaccgtaatcaccgtattgacaatcgcaatcaaaaactgtgcttccaaaacaacgccaaagctattcacaaactttttggcaaagaaatggacgtcttgaaagaaccagccaaacgtactagtcaaaaagcgcttcgtgaagacccgcatctgatgatcctcaatcgtaaagaagaaacttaaaataaatgataagaagaaggttagtcccatattaccaatattagtaatatactggaacacaactgaaatgccgcccttcaattgtttgagtatatccgattcttgaaaatacgatgtcacccacgtcaacacttggttagtatcatgtgatgggttctgataaaaccgatagactgattcaaacgtcaaaaaagtttgtttgatcaactgcggtaaataaatcgatacagcaaagtaaattccaagaatgactagtgcgtagaccactaggacaatgatcgtcggtggaatcttcacccaccgccgaactgcccgaactaaccgcgtcactaagaacgtaaaaataaacgttaataaaataatactcatcatacttgatgccaagtatagcgttaacacaatcaacgccaatacgcaggcgcgccgccagcgcacatttcgtattaactgtgaccaaaattccacaaaatccacccctctactatcccttactcctattctaacggaaagtctcagcaataaaaattaaaaggccgttgtgaatcaacaaaaaacgtgtcaagtttatcactaatcgcacgataaacttcacacgttcgtttaaataaacacttaataacttatgagaactgcatctttaagctctctaatcctagtgcttggtgaataataactgaggcgccacccaacaaggccgccgattgtacgttcttggttgcaatgattggaacttgccggcttggcgaagttagcttggccgtgctctcccgaacattagtcaatagttgtggcaagatttctagaacggtcgtgttcaacacaaccacatccggcgcgaacgccgtggaaacattcgcaatcactttagatagatagtaaacaaagtcatcgaagacctttgtcacttccggatcatgattgatgtagtcatgcttgaccgtcgttaaatctaatcgttcaacatgcttgatggccttcaaccgagcccacaaggctttttcagaagcataatcgttaactgatgccaagtggtcctcaacgtgccgatcttctaacaaagcagtccccacttcacctgcttcgccttcatgaccagaatatagtcgcgaatcagccacgatgcccgcatgaatctgatcgcgaacgactaccgaaaccacgttatcgaaaatctcgttgtcatggaaatcacgttcaaaaacggccgttaagttagctttcttttccagaacaaccggaatccgtagcttatcacgtaaatactttgctagatcaaagtgtgttagtcccttgatcggtgtcttgaggattttattctcataaataatcccatccagcgcaatggcgacccccatcagaccatgaatcgtaccatagtcatcaacgttccgtaattgatcttcaatcaaatcaatgacatccgtcaacgtcatatcgctcgtcttaaagctttgaaagtgcaaaattttaccattcaaccgtgaatacataagtttgactgcgtcagctgtcatgtcaatgctggccacaaaaccatagttcacgttcagctcagccatcactggtttacgaccgccgtttttcgtgctgacaccacagccaatttccttgatgaactgggtccgcagtagctgattataaatatctgaaaccgtcactttattcaaactcaagttccgtgaaatctggctccggctaatcggtccttcgttaataacctgctgcagaacttgcttttcattcgtactgcgcattacatgtttattaataatcatactgaatttcgatgcccaccattgacaatcgaactactttaccaaatcatgttaatttggtctgccattaattcaatcatcaacgggcaccttaaccccctaatctgttaatattctatagcatcaaacaaaaatagtacacaaaatagtcaattttatacccattttgacatatgaacgttaaaaaaaggtcaataccgatataaaatgaccgcccccgtagaaccaaaatatcaagaacgaaaactttccgtccttactcctacattctataacagtttttataaaaaaatcaccgattgacacctaaaagtaggtgttttatcgatgattgttaagtggacttccatactgttattaaattgtttatattactgcaacgacctcgctgcttgcgccagagacatatgttgtaaactggcttgttgtaaaatggcctcgatttgggcatccgtatactggctagcattaaatccagcttgcgctagctccgcacgcgttgcctgaatctgatcagagctataattcatcgtttgggcagcttgcgccagtgagaggtgttgcgccgctgctcgttgcagaatagcacgaatttgggcatcactataactactgccgtcgagcccttgcgcggtcaactcagcacgagtcgtctgcacttgactgtcaccataactgttgttagctgcagctgacgagcccatcgaatggttagctgaggaagttgatgatgaagcagccgcctgctgtttagtggttggcgtgcgttgcgtttgttgctgacttccggtcatccccgtaaccgcttgtgccgcactcgggatcaccggcgctgaaccggtcaatgtcttgagtgacgcattattttgtttctgtaaatccaacacatttttccgaatatcctgatagtaacgttgcttaaacgccttatcctgcaataacttagcaattacaacgttagaatccgtaaactcattcgctttattcagctcagcagctttctgatactgttgttgataagtcttgcgtttttgttgcactttttttattaaggcaagttgttcttgggcctgattaattaacgtaactgcaccgtgcttggtcgtcttaaccgtcataaagtcacgtttagccatgtcaaatttccgcgcagccaatgcttcttgaccagccacataagtctgggtctgggttaaataccgttgcgcctcagtactactagctttcgttctggtcgcatgtgtaaaactcgtctccgctaacgtataattccgcgcttgcagtgcccgctcaccagttcgcatttcagccgtgtatgagtcttcctgcagacggtaccgcgtatatgaataactaccaacccccacagcgataattactgcaaacacgatccacatccatcttttcatcacgacacccccatcaactgattttgtaattaatttattataacatgtttacgaatcaggtcgcgattcgttgtgcttacaaaactgttttcataagcgtataataattagtgtattttacgaagaaaggatccttattgcaatgctagaaaaaaccttttaccacacccttctaagccactcattcaatatgcccgtcacagtcaactactgggatggaagtagtgaaacttatggtgaaggcacaccagaagtcacggtgacttttaaagaagccattccaatgcgtgaaatcaccaagaacgcttcaattgcccttggtgaagcttatatggatggcaaaattgaaattgatggcagtattcaaaaattaattgaatcggcctacgaatcggcagaaagtttcttcaacaattctaagttcaagaagttcatgcctaaacaatctcactctgaaaagaagagtcaacaagacatccaaagccattacgatgtgggtaacgacttctacaagatgtggcttgatccaaccatgacctattcttgtgcttacttcaaacatgacactgatacattagaagaagcccagattcataaggttcatcacatcattcaaaagctcaacccacaacctggcaagaccttactagacattggttgcggttggggtacgttgatgttgactgccgctaaagaatacggcttaaaagtcgtcggggtcacgttatcacaagaacaatataacctagttgctcaacgcatcaaggatgaaggcctcagtgatgttgctgaagtccggttacaagattaccgtgaacttggcgacgaaactttcgactacattaccagtgttgggatgttcgaacacgtcggtaaggacaacttagcaatgtactttgaacgcgttaaccactatcttaaagctgacggcgttgccttattgcacggcatcacccggcaacaaggtggcgccactaacggttggttagataagtacattttcccaggtggctacgttcctgggatgaccgaaaacttacaacacattgttgacgccggcttacaagtcgctgacgttgaaaccctccgtcgccattaccaacggacgactgaaatctgggataaaaactttaacgctaagcgcgctgccatcgaagaaaagatgggcgtgcgcttcactcgcatgtgggatctctacctacaagcctgtgccgcttccttccagtctggtaacattgacgtcatgcagtacctcgtaactaaaggtgcttcatcacgaaccttaccaatgacccggaaatacatgtatgcggataaccgaatcaataaagcttaattaaatgccaaaataccaactatctcgattatttcgaaatagttggtatttttttgaccatttttcaggaatgactgacaactagctttcagtcaccgccatgcgtacccaacccaagatctgatggtagatgagtaacgatcctaggaagaaagcggccgctaaaccggcggatgtcggtagtttgttaaacatattggctggtaacactaaggctaatagtggaaaggcatacgctgctggcaattgtaagttaagcgcccgtaaccacaaatacacaagtggtaaggcaatgaccgtcgttaatagccacgaagcaatcaataggtgaatgccgaccccaatactagcagcagccgacaatgcaagccactgcttaagtgcggtcgttaccgtatattcagactgttgagccgcttcaaagaaaacgacgatcacgggtgggattgcggccatctgggactgtcccgctagccaaacaatacccacccagacaaaaactaggctgataaagccgagcatttgccagcgactagcagaagcttcggttacccgtgagattgatcgcggtcgttgaatccaagccccaatcatcaggcaaatagtccagaaaaagatggctacgataaaggtccagtgcgttgcattaatgataattggcagtaagccagtagcaaaggctggcgccaaattcgattttaaccccttcaataataatagcatcagtaatagaccgacaagcactttgagggcgtacgaccaaggtagttgattgactaagaagccaataattgcagttccagatggtactaagaataactttaagggttgccgagtccacgccgtcttacgataaacccacgtcccggctgtcagagcaccgatttcgggtaaaatgatttccgcatcatgttgcaatgtggcactcgccaccattaatagaatgaagctccacccagctaagtatcgccaaccatcgctttgctttaaatccatttcgacaaaatattcctttcttatatttaattagatatatttatattatcaaacgtcaacgactagcattgtaccataaatacaatcgtctcctcaaataatcctgaaaacacatcaacagttttcaggattattttcaaccactttcctgacctctaaatcaaaattcgactgagtaaagtcttacccagtcgaattcagtcgtcgcgccaacgcagtcagaaaattatgcattttgcataagccttttgatacccgaattgtcaaatcaagnnnnnnnnnncttcaattttaaatccggcaagccttttgataactaaacggttatgctatttatcgtactagtaattggttaaccagcctacgtacactagccgttacggcctaacatcaaaaatatgaagatggcttctgctactcgtaaccaccaccgatatcggtgccaacgtaataccgaccaatggtgttttaaccactgattggcatagtgcgcaatcagtggcgccccgataatcataaaaccctcggtccaaaaatcgacgcgggcgggccaagtcgtgttatcaaagccagcaccaatggtcgcaactacgagcaagatgtagaggccccacaaactgatttgtaaaggtcgtttgactttcggccaccattgccgggcctgtattcgcttaatcattgattgacggtgcggccgataatgctcatgaccaggtaacgctgctaacattgcagtcgcactttgatatcgttgctgtgggtctagggccgtggccttcataataatcggggcccatgttgaatcctgtgtcagtgtcgttgtatctaacggcccgctcggctcttgaccagtcaacaaacagtttagaacgacccctaacgaatatagatcgctccgttgatccgtttgggcgaagccatagttttcgagagcgtaaaatatcttgnnnnnnnnnncaagattcttgacgctacctagttttcaggtgcggcaaaaccgatcgtgcctaataaacgagtatcactgtcttgctcagcatgatattgtcgcgctgcgttgacgtcaatcaaatagtagtgatcccgataacacatcacgttacttagtttaaggtcccgatgcacaatttgttgttgccccaacgcctgtagcgttatcaacaattcttgtgcgacgcgcaccgtcatttcgggggaaaacggtccttgtgttgccaatcgatccgctagtgtttgaccattaattaaggtctcaacacttacaatgcaatcagccgccgttaataatgcttcgatccggggcattcggggaattggctgctgcttcaaacgctgtagaacaggaatattatcaggatttactagtttagctaccgaaacaacctgttgcttcttaaccagtaacggaaactcgcgttgcgcaactaatggtcctagtggttcataaccagccgtacttaacaattgcattgcttgaacaatcggtaacaccgtgacacccccctttttatcaaaattactaacttttatcataaccatacttttggaggaattacaatgtcaaaatatcagaataacgaagtcacaccagtcgcaccccattcgcgaacagccgaattagttttaggaattattggcggtatcttcggtatcattgccggcttactggcgatgaccatcggcggcatcggtagtgctttagaaaccagcggatcggctggggtcagcaatcttggcgttggctgcattattgtctctgtcctcgcgattattttaagtgtcatgattaatcgcaatcacgttttaatgggctggttgatcatcctttgtgggattcttaacttcgtctttgtcagcttcttcgggattctaagcggtctgctcattgttattgcgggcggcttagcactaagaaagtaggtaagctcatgcaaaaaacgaaagcttggtatcaaaaatggtgggcgtgggtcctgattctccttggcatcttctttgtcatcagcctcgtcaattctccacaagacggtaaaaactcacaagcagcgacgaccaaaaagaccagcgctagcaagtccaccgctaaggaaaccccggcaaatacgatttataaagtcgggcagacagccaccatcgatcacgtgcaagtaacggttaataatgttaaaaccgcaacgacgctcaatgatgttcagcctaaaactggcaatcaatattatacggtcaccgtaacattgaaaaatagcggtagagataaagtcagctataacccgtttgactttaaaatcaaggccgccggtaaccaaactagcctagatgagatcaacattgatgaaaataaccaattagatagtggtgacctgaccgctggtggctctgtcagtggtaccatgactggtcaagccaaagcagatgggtccgttgaactcatctacaatcccagctacttcagtgatcggcatttgacctttaaattacagtagtttctggtacactaatactaattaagaaggagtattaggggggcactaaccgtggtagaacgcgcaactaaggaactatttaacgaaatcaaacatgcaagtgaggccgaccaatttatgacaaatatggccactagttttattcgtaccaatccggcggaatacctcgccgagcttattcaaatcaaacacgtcactaaaagccaagtcattcggcgcgctaatctaacgccctcgatcggttaccagtacttcgatggcaagcgccgacctaaccgggctcgcatcatcgccctcggattcggttttcaactgaccctgaccgagcttaacacgatgctcaagcgaactggttacgccgtcctttatgctaaggatgaatgggatgctctggtcatcttcgcacttagtcagcgctttgatcttaatcgtactgatgaactactttatcaatacggtctaggcacgattaccgacgaagattagcgtagttgccaacatccacactaatgtcctatggcagactcacgccaactaaaagttcggcataaccaggttctagaatactaaaagaccaggccctaatgagttgaatgctcattagggcctggtttgctcaatctaggtcaaagataaagatgatggtttcaatcaatacaatgaacgggatgtatcgaacaaataagataaagtaccagaaggcctcgttaaaactcacaacattgaatctagttatccctagaataatcaaacagctaactagtatcaaaattgaaaatagcttttttatccttaatcgtttgccaaactctgaccccataattacggccagcaacagcccacaactcacatacccagtgagctgattactatccagcttaaatccaacctgaacccccgtcgaaaagtaaagtgccgcaatgtatatcagcaagtaaatccctgcaataacttgaattcgtctgtagctattcatatgtctccccaatttagcagttcttagaataaaactatactaaaaggaaaccaataagccaatgcttttttcagctatgtagcacctgtaattaagcatcgttaaaataaaaaatcttcaacaataaatatttcaatcccggttgttcaactttagaaccgtgcgcaaggccgattaagaagctacagtcaggtacgctcaatggcactatcttactcatccacgtccgctccaaaacagataagcgctgttccagctgtagctggcaaattcttgattattaaattaataatattcaatttatacattgggattaactcgtttataaccgaagacagattgtcgaagtgctaccgctgctttctgaaaatattttttaacacttggacgctttgcaccatcaaaaaaggccaaacgcattgcgcctgaccactaaaatcaactcgtaatgaaggtgataaatacctcgttctaaactggcgcaatcaaataatacccgccactaagtccaatgaacaagtagatcaaatgccggactgtcgtcatgggtagccgcggcaggattcgtgccgccagcgccgtcccaatgaccgcacctaccataccaatcataatatgggggagcaagactggcgtcagaataccgttcagtacgcggactgtcgaaatatagaccacatcgatcaaaaagaaagtctgcaaatttcccaagtaatccgcagtcgtatcggcaagtgatagaaaataaagggccatcagcgggccgccaataccgaataacccattgaagaaccccgaaataatcatgaagagaccggctaaccaccacggataagtctgattcgccgcacgcttgctcagactaaagtacccggctaacgaaactaacagcgcacctaataaccgtcgcaataattgcacatctaaaacttgaccaagatgtaccgaataggccgccacactggcataaacgataaacggcacaataatctgacgaaagtggatatgctgatgataacgccaaactaatgttatgacactggctgccataataacgcccgccacggccgcactttgagcaatcggaaacaactgtggtaaaaagatcatcatgacgatggccgcaccaaagcccgttaacccttggaccagaccagccaataatccgggtaagaaaaccaataaccataccatcaacgtatcctcttttcatcataataaaaaagaaccgggtcacccagttccaacaaaatctaaatatgaattagtaacacaaaaatcatcactgagactagaccaatcaccactgataaagtcattgaacgcgtgcgataagccacaaatccaacgagaatagcagaaataatcatccccagattgccagaagtgatcactgcgtacttactatcgataaagacacttttaacaactaacgccgtgaatagtgagacgggtacgaaccgcatccattcattaaaccattctgggatcttccgcttcgtaaagaacagtagcgggaaaaagcgtggtatgaaagccacacacgcacaaaaaatgaccaaccaaaaatggtccatactactcattgagctgactgattgcataagaaaaacccctctgtgccctacttgtcagattcttccatggctgtttggccagtaggatcgtgaaccttatagagtaaatgactttctggcttatgtgccaacaagtaacgttcaataaagtaaccggtcaacgacgcgagtagtgttgacaccactaggcccagcgtactcttcattaagaccagaaaacctatcgttagaacgccagacaaaactgccactaagataatcaagcggctcttagtttgcataattgccatataaatgaatagtgccgtcagcgcaaaatccaccacttggagattaatcgtcaatgcactgccaatcaaactaccgataatattacttaccgtccaaaataataacgaatagtgttcgaccattaaggcctgcgatggcttccaatgcttgtccgtcgcaaactttaaatagttgaccgcgtaattttcatcattcatcgaaaacgcaaacgtaaaaatgaacggtaatgattgccccttcagatagcgcgataagctggaacctaataaggcgtaccgtaactccaagaaaaacatcatcaaaataatggttgtcatcggtgcattaattgtcagcatcgatgcaattaaaaattgggcgccaccggaaaagaccattaccgaaattaacgccgtcagtagatggttgaacccggccgcatgcaataaaaccccacaagctaacccgatgggaatatagctaagcccaagcggcattactgttcgtaataccactaaccaatttggctcgttctttttcaccaagaatgcctccagtaccataccagtaaagaattctagcaacaacagcgagcgtcaaattacttagacactcggacttaattttaacatgttttttattgcaatcctacaccttgttaagtttttaagtgtatgtaagcggtatcaataccattttttacttgaaatgttgtcccagaatcactaagtcattcggtcggccacctaattcagcgacttctggcagaaacccccactgttcgtacccaaactttttgaacagcttaatgcttggaatattacttgaaaaaatataagcgataatcgttgttaatcccaacacaggtaattgtttaggaactaatgtcaaaacctggctaccgattccctgtccttgaacactgcgatccaaataaactgaaatttcagtcgtctttgcatacgctgcccgtccataaaatggagataggctaacccaaccgaccactaagtcgtcctttacaacaacccacagcggatagtgttcaggggtatgactcaaaaaccaatttcgacgttgctcaaccgtaactggtttaagatcagccgtcacttgatgactgggaatcgtttgattgtaaatatctacaataatgggtaaatctgacatggttgcagttcgtaatgatacgctcataggtgactttcactccattcgttttaactactgttatcagtctttattatacagttaatcgtggatcatgctaacaaattctatataaataaaaccgcaaagctagtattcaaatatcagcaaaaaagaaagaacgctcaaactggaacgcttgtagcgaatagtcgaagtagtgactaagataggcacacggcctaatttagggaataatttttaacaaagcacctcataattatcccgatttaaacgttgcttttttagcatcgccaaatgaagactattaatactctttttatcataacatccgcagccgttcaacttggtcatccttgacagtgcctttttgaaattactctggatgctaattatttttaattagctaaatcagtggcacagccctggtcattagttgcctgtcatgaatcactattgccaacaaaaaaatcctccttgagcaggcaagactcaattactagcttgcctactcaaagaggaatatatcttttaagaaatatctcgtagcgtttactaagctaatgcacccacagaatctaatacactaactgctataatttatttgaaccagctcttaaccccgcgccacatccgtacaaagatatttgctttgtcgatggacttcttaggcgttacattgatggtcatattcttactagtcgttccgtcaactaccttgatagctttcttgcttaggttcaagttaacagtaccgacagtcttgccattcttaacgggtgcttgtaatttaccatcggttgtcgccgacttcttcaagctaaccttaccagtaacggcactagcatccgtcccggttggcaagtaaatcttggttgcaccactatttgaaacgagttgcaacgttaaggacttcccatcttggacatcaacggctttcacaccattgatcttgccattcttgttaatcgtcgtagtcgtgtagttgtggtaaacatatgacatgatttcagccgtttgagtgaaacgttccgtcccactatcgttagcggcaccggcatgcatgacgaccgtaatgatccggttaccattgctaaacttaacagtcccagtgaaggcattcccagccttagtggaagttccagtcttcaaaccatccacaggaagtgcggagtaatgtttaactaatcctttgagcatgtagtttctgttatccatcttggttgctgaactagtgcccttttcaaaccaagcatgggcaatgctagaagtctttaaaacttctgggtaatctgataatagcttttgcgcaacggtagcaacatcttgtgctgacatttcgttttcagcactgacggcaacgttactgtacccaattgtgctgccaacctctttattggttaatccactggcattaataatggtagcgtccgtgatcccccatgatttagccgtcttccgcatcaagctaacaaacttatggggcgtcccggctaccgcgtcacccaaggctgtgatagcggcgttagcggaatagatttcagtcgcgttatataattgccgcactgaatacgtcttcgttgataataacggtacgttcgcatattccgtgttttggctcatcttagcgactgccttgctaacactgattttttgattccaagacaacttaccttcatggatcgccttaagcactaaatatgtacttaacatcttcgtcattgatgcgatcgccattggcttactactgttcttatcatacaggatctgaccggtcgacgcgtcaaccgcaatggcggctttcgcagagatcgatggtgtactggctgcttgggcctggaggtcagcccccgcaatgcctaaaccagctgtactaaacgtgactgccgcaacgagggcaatcataactttctttaactttcccgcaaatctcatttctcaattatccctttcttaattgctaatgctagttttagtttaaataattatgtctgtggaaacaagttaatttatcatatccgattgtttttttgttaatgggtggtcatgtttaactggcaaatgaataacaaagcttgtctgctcatcatcactttgcgcataaatatagccaccgtggtgatccacgatactttgggcaatcgctaagcccagtccagaacccccggtcgccttagaacgcgattcttcaacccgataaaaccgttcaaataagcgtcccaacgactcagctggaatacgctgaccatcattcgtgacgtgaatcacgacttcttcaccacgttgttcagcttgtaatactacgtttttagcaccagttccatatttaaacgcattagtgatcaaattgctgaagacccgccccagcttttcagcatcggcttcaatgtaaataggctgcgtgccactttctacttcaatcttcagatgcttcttgttcgcttccagctcaaagcttgccgctaactgttctaacatggccgtcaagtttaaccgattaatggccaacggtgtctctgtctgccgtgatttcgtatattcaaacagatcttcaaccagtgacttcatttgtgttgccttcaaataggcaatatgcgcatatttaattaaatcctcttctgattggtactgtttgttctcaattaagcctaaatagccgataattgacgtcaacggcgttcgaatatcatgactgacattcgtaattaacgcatccttagaccgctcaatttcccgttcctcgtccatcgagtggattgccgagtctactaaggcattaacactttcaacgactcgttgtgtatcaccagtcagattaaagtcaatccgatggtcaaagtggccggccgcaatataatgcaactcactaataatatgtcgtaactgcatctgtttgtatcgtcgaattaatcgccaatataatacgaaaccgtccgcaatcagcatcagtccaataaagatattttcataactccatagctggtagttattgggaccaatggtaatcgatcgtttaatttggaaaataccgctctgtaaccccggattatgcgcaatcgtactgttgatcagtactacgatcgacaagtttaaaaggagtagcaaaatcaccgtcactaccccttcaaaaaataattcacttttttcgcgtcccgttaatttcaaaagctaaccctcactcttaacgcgattcgatcttatagccaacgccccaaacggtctgaatgactttttctccatccgtggcttcttcgatcttatcccgcaaatgactcacgtgcaccatcacggtcttagctgagacaatactttcttgctgccaaacacgttcaaaaatatcatcagctgaaaagactcggttaggatgacttgcgagcaaatacaaaataccaaattctaacgcggttaattgaatatccttacccgtcaacgttttaacttcgtgcgaatctttattgatcgttaacggtccaatgtccaaaatatcaggctcggtagtcgtcacgttattttcagaacgtcgtaatagtgacttgacccgtgccataatttcaagcggattgaatggcttggtgacgtaatcgtcagctcccgtaatcaagccctgaatcttgtccatatcgccagtcttggccgacaagactaggattggaagttgggaatctttccgtacttctttgatgacctcaatcccatccatttcaggcatcatgatatccaaaatcattaacgcaatatcaggattcgtatttaatttagtcaaagcttcacggccattataggcgctaattggttcatagccttcgtttttaatataaatttctaatagttgtgcaatttctttgtcgtcatcgactactaaaattttcatcttatttttctccttaaataattctgtttttattttaccaaaaaagcggccgggcttggcagttaacgattgattttagagaaaacgcaactattccgcgtcatttgccgtacggtgaactaataaccaggtatagtatccacctactaagatcaataatcccgccgcaacccatatcgtccgtaatgtccaccaccgctgcaatatcgccgaaacaatcgcgcccgtagcaaagctcaacactaattcccaatacactaaaccagtgtcaagctccgtgcgcacgcctgtcaaccaataattcgtcagcgcgatcgttgccttcttgagattaccggtagagaacacgttattatagccgtggccggcgattgcgctgaaggctgtcgtctgcatcgccatcacgaatgcgagtggtgggaccaccatcgcattactaacagtcgctggtagcatgccgaccattaaacaaacaaccagctctgccaccaaaacgggcaagcgccagtagtgtgaccgcgcgcccaaccattgtttcagtatacccacgacaatcacacctagtgtaaaaaagaggactgttgctaatttagtcaacacacccggtaaattccactgtgccacatcaacactgagaaaaatcaaattacccgtttgaccagctgctaagacaccaccccgttggatgaatgtgtatgcgtcaataaagccaccgatacaggttaagcccaagccaatttctcgtaactggaataaatggcgtgactgaaaccgttgcatctactcacctacttaatatgttgaatttggcacctcactaaactggtacaatacgttttaataagtccatcatagcgcaattaatcatcagtacctaacgaaaacgcgccttttaacccatgacaggttaagagacgcgttcataatcatcacatcattgctgatgattctattgttagctattttgggtggttaaataatcattaaacgctggtgcgaaatgggcatcaactaccttaacgtgggccgctttgaaaactgaccgaatcgtcgcaacttgcgtctgcttgtccatcatccgctgttgctggattttttcacgcaaataatttgtcacatcaatctgcttaccgctatcatcagttacagccgcagtcttagatcgacgactgacaacgttgataatttcataagttggtttgtctttcgtgtcggcagttgccataactgttttgaccggtttcgtgacatagtgtcccactcgtagtttagctgtggcctgtacaattgctggtgctagagtttgattataactgtcaaactgcgctaattttccagcagttgtgtgcgcttgtcgattattctgatattttcgcacttgcgaatcaaagctagcacccgcattcagttcagcaataattttttgcgcttgcttctcattggccgtcgcaatgtgttgaaccgttgtcattggcatataagctgctcgggctttttttagttgcgctttagtcactggatacttagcactaacggctttctccatcaataaattcgctttgatttgcgattttaaacgcggttcagtgacatgattacgttctaaaatcatgtgataatttgcgcccgcctgccgtttgaatgcttttaatttagcagttacttcagcttgtgaaacatgatatcgttgattaaggactttgtttagagtcaattcttgaacagcctgttgcgtcgtcgcttggttttcaatttgtttaaatacttccgcttgtgtgacctggccagcatctgacttgaccaatgtcgtagccttcgcttgacaccctgttaacatgactgcgacgactagactcgcacctacccctattaaccgatacttcatttatattagcccctttctttgcatcactaatgccacgatatcattaaaaatctaatgaacttaataagtaacacaatcgtgtacagagctagtatcaacgtcccaacaagaaagaaacactacggtcaatctacacgaacgttacatctgcctatatcttccgctggtactcaccagacaaaaaaacgtagaacaaagttgatgttctacgcttacttgatgcttattcaactaaaccaatcagactgactcatacgatatcgtcattttaaccgttgactgaatagttcggtgcattctttgtaatttgaatttcatgtggatgtgattcgcggagcccagcgccagagatttcaacaaactgggcgttttcgatcaaggcatcaatgtctttagcgccaacgtagcccatgccagaacgtaaaccacctaacatttggaagataatatcatcaacgctgcctttgaatggcacacgtccttcaacaccttctggaactaacttgttcgcttcgttcacgccgccttggaagtaccggtcagacgaaccatgagcttgtgacatcgccccaacggaacccatgccccgatagaacttgtattgacggccatcgtcaaagacaacctcacccggtgcttcggctgttccggctaacatactcccaagcatcacggcgttgccaccagcagcgagggccttaacgatatcaccggaatacttgatcccaccatcagcaatgatagctttgccgtattcgcgagcaacgctggcagaatcataaaccgctgttaattgtggcaccccgacaccagcgacaatccgggtcgtacagattgaaccagggccaatccccactttaacaacatcaacaccagcttcaaataaagcacgcgtgccttctgacgtcgcaacgttaccagcaatcaatgtctgcttagggaagtgggcccgaatttccttgatcttccgaagcacaccagcggaatgaccatgagccgtatcaataacgatggcgtccgcaccagcggcaaatagggcttcagcccggtcaaaggtatcactagtgaccccaacagccgcaacggccaacaagtgattgttggcatcaacggcagcgtgtgggtgatcatcatccttaacgaccgctttgatcttcttaacttcttcagcctgcgcttcaatgcttaagttcttatggataacagctaagccaccttggttggccatcgcgattcccattgcggattctgaaacagtatccattcccgcactaataattggaatattcagctgtaaattatcggcaagtttaacacctaaattgacttcattcggtaaaacatgactttcggccggaattaatagtacatcatcgaacgtataacccttttttccaaactttgtatcccaattagacattgaacgttagctccttatgtttttatttttatctgtaaaggtaacaaaacatcgcgataaatgcaaggggttgcgcagattttcagaaagttcttattttaagcctgtaacgcccaaccgaatgttccaggttgggccgagcgtacttcacacacaactttcattcagtcattacatccgtatcaccagtttaaaagctaactaggtgaataacaagcaatgaccacttgcaatcgacaaaaagacaagccaatgcacgccatcagcttgtctttcagtccgagcctaaaacatgctcgtcgtaatattaaagcgccgcttcaaccacatccgggcgaagaagacgacgacggcaatgatcaagtacgcgattcctggtaagaccgggttcaatggtccttgaatcattgacatggttgtaaagactaacatccaaacgatgatagccagtactgaccacgcgattttcttccataacgaaactttcttgccatctttagcaggcattaagtattcgaataacttagcaacgcccaaaccaccaatggcggacgtaatcagaatagcggtgatcccgttggcaccagctgaattcttagtagcgttcgtgccgatgaagcccatgatcccgtacattaagcagaaaatcatgaatagcatcaagccattatccagcgccgtgacccaatagttcgccttttgacgttctaccggtgtcttttttggattcacaatctcttcggtccgttcttgaacggtcccgtataattgacgagccgtggttccccgaccttgttccgctaacaatgtagacgtcatttcattcagaactgccgtctttttctcaccactcaacgctgtggcatcaagtgacttgcgcatctgacgcatatattcagcattgcgcttcgtcaactcagtcgcttcgtgaactggccgttctgcggcttgagcctgcttggccccggccgcggcgttcctaggtgtctttgaagtttcgctctcactcactatacaattgctcctttcagcttaaacgttgaagcggaattcgacgatgtcgccatcttgcatgacatagtccttaccttccaaacgcagcttaccattttccttgacctttgcttctgaaccggcttcatccaaagcatcgtaagacatcacttcagcccgaataaatccacgttcaaaatcagagtgaataattcccgctgcttgaggggccttagtaccgcgtttaaacgtccaagcccgggtttccttaccaccagccgtgaagaaggtttccagtcctaatagcttgtaagaagcccgaatcagcttattcaagccaggctcttcaacgccttcagctgctaaaaagtcggccttgtcgtcatcatctagttcggcaatttcttcttcagtttcagcagcaacaccaatggcttgggctccttcttgcttagcatagtccgcaaccacttggaaatacttagagttttctggatcggccatgtcatcttcggcaatattggctacatacagcactggcttagacgttaataagaataagcccttgacgatttgttggtcatcttcgttgaattctagtgaacgcacgggtttgccggcttccaaggcaggtttgatcttttgcaaaacagcgagctcagccttagcttctttatcgctccccttagcagcccgttgcactttagccaaacgcttatcaacagcttctaagtccgctaaactcaattctagattaattgtttcaatatcatcttgcggatcgactttacccgtcacatgggtgatattgtcatcatcaaaggcccggaccacgtgcacaattgcgtcaacttggcggatgttttcaaggaacttgttcccaagtccttcacccttactagcacccttgacgatcccggcgatatccgtaaattcaaaagtcgtgggaacgaccttctttgcggggatgatttcttgaattcggtctagtcgtttgtcgggaacttcaaccatcccaacgttggggtcaatcgtcgcaaatggatagttggccatttcggcgcccgccttcgtaattgcgttaaacaatgtggatttaccaacgtttggtaacccaacgatacctgctgtaagtgccatatcggttattcactcttccttttttaataattaagcttgatcggctttgctttctaatacctttttgagttttttattgaactcacgacgcggcatcatgaccacgtgaccacatcccgtacatttaatcttaatgtcagcgcccatccgggtaatttcccagcgattgacaccacacggatgcgcctttttcatctcgacaatatcacctaaatcatacatgcgcaacgcccctttataaattaattaatttaaatcaatactgagaatttctaaaatccgtgtcaaatcttcatttgacaagtacggaatttcaattttcccttgatcagctttgttcgccttagtttgaatcgaaacggccgtcccaaacttctcttgtaattgttcttcactcgcacggatgtacggtgacttcttgggtgcaacttttttggccggctccttggactcgccgttataacgcgccacgatttgttccaactgacggaccgtcatgttatccttcacgacgcgcttcgctaatggcgctaacttggttttattcttcaaagacaaaagcgttcgagcttggcccatggacagttggcccttttggatatactgtttgaccccatctggcaagcccaataaccgcaaataattagcaatatatggccgactcttgcctaggcgctttgagacttccgcctgcgtcaacttcagcttcttcatcaacgaatcgtaggccgcagcttcttcaagcggagttaaatcttcccgttgtagattttcaagcaccgctacttccatcatttgttcttcggtaacatcacggacaatggctggaatagtcgtttgatgagcgagcttcgacgcccgaaaacgccgttcaccagcaatgatttcatatttattcagctcggcatccggttgtcgtacaatgattggctggaaaacgccggacttttcaatcgagctggcgagctccttaagtgccgtctgatcaaaagttcgccggggttggtacggattggcatgaatatccttaagatctagatcaaccacggcttcttcactagctggttcgttaacatcggcaaacagggctccaataccgcgtcccagcgccttattatctttatctttacttgccatgagcggccaacacttcctttgctagagctaagtagacttgcgcacctttcgaacgggcatcataatcgacaatcgataggccgtggctaggtgcttcagataaccgcacattgcggggaataatcgtcttatagacggcgtccttaaagtatttccgaacttcttcgttgacctgggctccgagattggtacgggcatcgtacatagtcaatagcacgccttcaattcgcaactgtttattaaaatgtttttgtacgagcttgatcgtattcaataactgactcagcccttccaaagcatagtactcgctttgaaccggaatcaaaatcgaatcacaagccgtaaacgcattaatggtcagcaagcctaacgacggtggacaatcgatcaaaatataatcataatcatccttcacgtcatcgatggcatcacgtaagcgggtctcacgtgccatcatcggtgtcagttcgatttctgccccagaaagctgaattgtagccggaacgatatctaaacccttatgactcgttgggataatggtttctttaatgggaacgtcattgattaaaacgtcatagatttcacgttcgatggtcgacttttgaacacctaaaccactggtcgcattcccttgcgcatccgtgtcaattaataaaactttttggcctaattcgaccagactagccccgagattaatactcgtggttgtcttgccaacgccacctttttggttagcgagtgcaattacggttcccataattattgatcaccccttggttgattttttggaatttcaatcgtaatccgatacccgtcatccgtatcctcttcatgagtcttcacgggtaagccggcatcagttaccatcttaattgattttttgatcgtattcacagcaattcgcgtatcgccggtcaacccccgtgcacgtttgcgtttgggcttcggcggcgtttgggtcttcgccactagctgttctgtttctttgaccgtcaattgatcatcaagcacccgtttcaaaaccgcagcctgttgctccacagccaagttgagtagtgcgcggccgtgccgttcgctgatttgtcgctgcaacaacgccgtttgaaccggctgtgctaacttcaacaatctcaacttattcgcaactaacgactgacttttgcccaattctttcgctagcgccgattgcgttaattggttgagttccatcagttcttggtaggcccgagcctcttcaatggccgttaaatcttgtcgctgtaaattctcgatcagcgccattgacgcggtttcaccatcatccatcttttgaatgatggccggcacatctgcccaatgaagtgaagaaatggcgcggaaccgccgctcaccagcgataatttcgtatttctgcggttcgtattcccgcaagacaattggctgcaacaagccgtgatccgcaatcgtagcagccaattcagcaataccagtttcatcgaagacttgccggggttgaaaccggttggggataatggcagtgaccggaatacggacaatttgttgctccgtgggggtcgtggccgcctcggttttatgtttatcacgattagaaccaaataatgaaaatgccattgaaattacctcccaccttacattggtgccgttaacggctgtttcgccggtgtccccggcttgcgtggataccgcttcggtgacggcttcttcttatcaataacaatgatatggcgcggatcagcagtcacgggcaaactaaaggcctcgtcctgaacaatttggccccctaattgttgaacggcgtatgtcccttcagccgtttcagtacgggcattggctgctttcaatgcaatcatctggccgccaattttaacgagtggtaggcagagttcgctcaatactgataggcgcgctactgcccgagccgtcacgatatcgtagctttcccggtgagcagacttcttgccagcaaacgtttcagcgcgatcatggaacgttttcacacccgttaagcctaattgttggactagatcatttaaaaaattgattcgcttattcaatgaatcaacgatcgtcacttgtaactgtgggaacgcaattttgagcggaatcgacgggaaaccggctccagcgccaacatcacaaatcgtgagcggttgatcacgcagcgcaggaacgtagaatgctggcgtgagtgaatcgtaaaaatgtttaagataaacttctggttccgctgtgatcgtggtcaggttgaactgcttattagtcgtgaccaatagttgaaaatacagcgcaaattgtgccaattgttttgccgtcagcgcaatctcgtgttgggctaacgcttgtttaaattcttctggattcattagtaatagctctccttaaaggggtcacattcgtcctctttttgtgaaacaactcaatgtttcacgtcacctcataactttaacgtaaataacacttaaaatcaatgcacagccccgctgttaaaatcgcaataacccttgaaaagtctgcttttacagccatcattgacagctattctagtttgcaatttttctagtcaaattcatgaactgccttgaacatctcaccgttaaaaacgacaccggataaaagtatgacccgatgattcattaataaaaaagaggccagccgaatagctgacactcttacgtttaattcaagattaaattatatcaccgactaccaaacgaacaacccaacgacaccggctgatagtaaggagaccaggatcccagataatagcatgtaaccaacattccgtgaaatcaaatcgttcttttcacgatcaacgattcccttgaaagctccaataatcatcccaatcgttgagaagttcgcgaaggacgttaagaagaccgttaagactgcccggaaatgcggtgcaaaatcgttaactttgctggaaacttcacccatgacaacgaattcgttagtcactaatttcgttcccatatatgaagccatttggaaagcatcacttgggttaaaaccaagtaaccatgcaaatgggaacatgacaaccccaaagatgttttcaagtgataaattgctattgattaaacctaacaacttatcaattaatttggctaacgctacgaaagcaataacgttagcagcaataatcaaaatcaagcgaccagcgcctaagattgaatcacccaagaaagagaagaatggttcgcgagctggtttagcttccttaacttgttcattagctaattcttcagaaccgctcgtttcagtggtggcagtagtttcttcaacagccgcactacctgagattttcgcaatggtatcttcttccggcttaacttctaccggattcaagattgcagcaataatcgcagcgtttaagacgttcattggcaccgccgtcaaaatgaattgaccaggcatcatcttaatgtaagcccctaagatcgatgccgtcacacaactcattgacatcatcgcaatcgtcaagtttcgttgtgccttcatctgcttcaattgtaactgcgaaacagcaagagcttccgtgttgcccaagaacatcatttcaacaacgaagaatgattcgaactttggttgaccagtaatgtaagctaagccccggccaacccatttgataatccatggtaatacgccaatataggtcaaaatatcgaataatggcacaatcaacaagattggtaataatgaactagtgacgaagtccatcgacttaacgttaacccaactagctaacgcaaaggcgatcccatcgtatgatacattgacgagccaagtgaagccatctgccgctgctttaaccgcgtcgacaccgacttgtgaacccgttaagaaccatgccaataagacttctagtactaacatgacaccaactgaacgccagttaatggcgtgcttttgcttggagaataagtaggtaatggcaataaaaaccacaatcccaataatattaactaccaagttaaagaccatgtgaataatccctcttccctatgaatgtaagaaatatgacaaaactacttctattaatttaccatttaatacgcacttgcggtagcactttttaaagaaaagcttaagttcttaattaggccgtaccaatttattgaaaggccccgtccagatagtgctggtaaccgtgagaattttagttatgtctgcccaatttcattctaaattttagtaattctgctaatcagagatcgaaaatttaggcccatcttgattaaccgttaacttattgtgactagaattaatttattaacttagtaatttatctgagtattctctaagtcgttaagttacaaactaatagcaataataaaacccacacattataatctgtaaaattaaagtatcatgattcaatttatctatatttctcaccgcaagtacccgtaattcaaagtcattgtatcaatcaagggccaatttaataaatcattatcagttaataaatacctcaaatcattaaataacagttgaaaatcaccagttacttggcagataatagacttttgttgttacaacccgggaatcattgagattgactatatctctatgttggttgcattcaattatttttagttaatctttttaaaactttatgccaatatacaaaggagaatttcatgcgtcatttggggaaagtaccagtttggattacttatacagtagcctttattattttaacttgcatcatttatagtccactatttctggacggacggtctttgatttggacagtagatgggatttcacagcatttgccaatactaacagcattccaaaaaatgcttaagggaattggcacacaatcattatttggatggtcctggaatcttggcctaggagccgatcaaatgacgacttttgcgtattacgttgtcggcgatccattcaactacttagtcgctctatttccaactactaaaattgaatttgcatatcagtttctgattttgattcgcttatatgctacgggcctagcttttttaacatttgctaggatatggcactttagccgcttaagtcttttaattggttctttaacatataccttcactgcttttgcacttcacatcggcatgcatcatcccttcttcttattacccctcatctttttcccattattatgttggggaattgagcgagtattcagaggaaaatcatggtggcccctggcaatagtaattgcaatcacggttgccagtaacgtttactttgcttacgtattagcactcgggagcgttatttacacaatctggcgttattggcaacaatatcgtcaaacaaaaacgtatgcacgattttggcaattgatttaccacttattaagcgctgttttagtcggtgtagcgtgtgcagcagtgttagttattccgaccgtcctcgccatgttgcactcgacacgtacaggtggccaatttgccaacggattatcgctctacccattaagttattatattgcgctacccaatttggttttaaatagtgatgggatgccgttttgggtcattttaggtatcagtagcctaacttggttagctattttacattcgttacgtcattttaaacaacgatgggacttaaatagtctactcattattttattagtaggcctattacttccagctgttgcagccacattcaacgttctatcttcgccctccaatcgttggctattattaagcactttgctgttcagcgttcttacaatgcgactcatcgatgactggaaaaaacttgatagttgggattaccgactatttctaggcgccagtgttggcttaattataattatttgggtcgtaaatggttttacttttaacgttagtgcgcgcgacctaatatcatatatattactattcgtcttaatcacctggtttatcgggtcaagtgcgatgcatttaagccgcttaacactgataattggctgtttcactctgctatgtcttaatctaattaatactggctttggtgcaactatgaccagttccggagttgccaatccacaacaactatatcgtggaagtgccacgagttggattaataaatatttggatggtgctcaaaaagctttaccgcgtaatgataatttctatcgaactacattaacccctggattctatgctagaggagctgcttctggaaagaaaaacatctcaatgttgctcggcacccatgatattgcatcctatttctcagtacagaatagaagtattagccaattttcacagtcaattggcaatcaagaggccgatcctaattcaccactaagcacagctgatggtcggacaacaacacgcaaccttctgggggtccgttatatatttgaactagcagaccgttatgaccctaaaaatattcccgtaggctatcatgctttaaaaaacaacgatgggcacgtgcgtatatttaaagatcaaccagtggccggtggattatctaacaaaaccggaactatcgtttttgttaatgacaactttttaccattagtatccacgcaaaacgctcagattagcgcagccaaatatcaacgattaaatgctgttgataaagagcaagcaatgatacaagcgccgattactgataagccaataactggtgttaaacaagtgcaacctcaaaaaatagccaccactgtcccctataccgttaaagttaggaatattaccgacaggccagtcaactcttcaagccgactaagccagaaattagtcactactaataaaaaaattgttaatgacaatcaaaccactaaccaagatggtctacatcaattagttagtgattgtcagggacatcaattgacctatgatttaattcttgatcatcctgaaaagtggcaaaataaagagttatatttagaggttagcggtatgacaatggtcaaacctacgttgaatcaatttttgcaaaataatgcggctaatgccgtatttgctaatcgccccaatacaacattagctaagattcaacagtttcgccaggcacttcatactgattggcaactcagcggttactatttatccgcatcaaccgcttatcgaagtaacaacttttcacaacaatcaccaactaatctttcgaattattcgattcgaaaacgtgttattttaaatttaggctattcaagtcatttacgaagaatcgtgaccgttcgttttagtcaagtgcctgaactaaaaatccatcatgtaaaattaatggcagttggatttaaggggcgctaccagcgtcaaatcaaggccattcaaaagcacggccttaaacaacaaaaggtaactaacaacaccattacgggtcgcactcaagcacaaactgccagcgtattaactacctcgattccatattcaactggttggcacttaacagttgatgacaaaccaactaagactcaagttgttaatacaggtttcgttggtgcaaaaattcccgctggtcagcataaagtcaaattacaatatcatacacccggattacgattgggcgctataatttcgttaattggccttttgcttctactggttagtatcctttggcaatcacacgcttggttgcataatcaatcaaaccagtaagaactccagtctattttctcgtattaaaatttacacgtaattcatgctttctgatcaaaaaagttcgattcgtcattgaatcgaactttttctatcagctcccattttgaataataaaccaatgatgaactgacttgatgacaactgaaaattcagtcgttaagtcccccgcaaccgcggagtgcccctgccaaggaattctattataccgcgtttagtccgtttgcgaactaattagttgacctgaccattaaatgggactaaactacggacaattaatgaaagggggtgatgctttttgagtaccatatgtaatcttaaagcatcagtctctgccctattcggagcacatgactgatacctttaaggagtcccgaccaaatttacttggtcgggacttttgctatctaaaagtgtgtataaacagttgcaagttgactgtgagtggcttacattaaaagtgcagtttatttggagatatggagtaacgggaaatatgaaagcaacgacaaaacaagtattgacaggcgctacctggctagtagttctgctagcaatgatcggtggtaccatgctttggcaacaacaagcccacaagtcaaaaccggtcaccaccataacagtgacttctactgaacgtattccaatggtgctcttactagatgaccacttaactcacaatcagattcagcaattaactgcccatattcagaacagtagtgccactcagacactggtcaccgccaaaattacagcgacggggaccgtgacatttaaaggacaattgctcaacagtgacaaccgcccctacatacaagtgcaactgcccaagaaccttgattcaaaccgacaaacgcatttattaaagcaactcctaaccgtcgcccgccagcagtttaaatttcgccggtttaaccttgtcagttacggtcgtggcggtcttactgccactaactatgtcgaacacacaacaacaagcttatcaccacaacaccttgtactgatggccaccccatttaacggtaccagccgccaaagtaacaatcgtcgccaaacgacgccggttgccgccaagtcgcaaacggccacactagctaaattgattgcacaccgccataccattgattccaagatgcaggtattgattgtcgctggaaaagccatcaaagctgaccaacccctaccactgcaaagtgccctggctggtcaatctatcttcaagccagtggtaaaggtctatcaacaaaaagtgttgcgctcatggcgcacccaatccggcttactcaacaaccatcaaatcggtaatacgattcaaacgtttataaactgatttcacccgtccaatcgacctagccatcatttttgctcagagtgcttatctaaaacatatctaaaagattaatagccacctttcctgacaaccaacttggtctactggaaaagcggctatttttagctttaattgtgcgatctggtcgtagtaagcctttaacgttaaaagcagccagcttaagtccgctgaaaaaagtttaagttagtgccaaccctgcctggttgagcgcgtcctacaacgccttccagtcgggatagcgttcgaatggcggacatgtgcgtattccgtttctgatgaattggccgtggctattttagcgacagcgactttgccatataactgtcagtctgataatagaattacgactgttccatgatctttatactgaggtattcaaaacagttgatgtcccattaacatttgttcaaagttcttagtagtaaataataatttaacgactaattgcaccagttaggcggtcgttcatctacctttcgagtggcttcccgaaacatgctcaatgccactgaagtctgtgctggctacgccaacgctctgcctaactttgctactgccataacatctgatccggatactccttggtcaaaaactgtttaatagcacgaatcatgatagccgttgaaggagcggctgcctgggttttgttggcaactaaggcaatctcacgattataaggttcggcaaaggaaaacgtgttaacatctccagttagcttccgtagtgctagctgaggcaaaatgcccatgcctaaaccggattctaccattgaaataatagattgatcatcaatcgagaatcgtaaaaagttattagtaacgtggtagtggtccagtgccagcttggtgtcccggtcataatcgctttgttgtagaataaagttcttatccgcaacgtcatcagtcgtgatgaattcaccattttctgggataaaatcagcgggcgtcacacaatagattggatcattgatcagtgaatgcactaataagttctcattgactggcatcgacgtaaacccaatatcgatagtaccgatcttggcccagttggttatttcattaaagttaccttgcatgactgaaatcttaatatcaggatatttatgattaaattcgcgaataattcggggtaaccagttgatacagacactactgaaaccgccgatccgtaccgatccagagtgcaatccttgaatattatcggcaacttgtcgcaagttactttccgtattcagaatctcttgaacatagggtaaaacctgccgcccatcactagtaagttcaacgcctgaacggttacggatgaatagcggaaaacccagttctttttccaactgattgatcgaatgactgaccgcacttggcgtaacgttaagcgtagcggccgcttgatagaatgtatgttgggcaacgaccgttgaaaagacttcatatgcgaagtttgccataatgatttacctctcttaggtgaatttatttcacttattattgaaaaagttgagttttactaattacaagctttattttatcatattgataatcaaagaaaacagtttaagtacaaaaaactgagtgggggaaaattattatgaaaaaattatttgcaaatcgcgtgttaaacaatgacacttccgacctagatgaggtcttcaagaatagtgcaaacccggaaaacatttccttcgctggtggttttccagatcagcacttattccctgacaacgacttaaagcaagcctatcgtgatgctattgaacacgatggtcaaggcattttccaatactcatcaactcaagggttgccggcattacgccaaaaaattgcagatcgaatggcgactcatgctgacgttcaagttagtgccgacaatgtcatgatgacccaaggtggtcagcaagccatcgacctcgtggcgaagctcatgttgaaccatggagatgccatggtcgtcgaaggcccgacttacatgggggctttagccgccttcgacacttacgaaccgacttactacgaaattccagttgatgataatgggatgaatattcgtcaacttcgtaaaaccttgaaagctcatcctgagatcaaattgatttacacgattcctgacttccacaatccaacgggtacgacgatgagtgccaaacgtcgtcaagcactcgttgcccttgccaatcagtacgacgtcattattttggaagacagcccgtaccgggacctccgttatagtggtcaaaatattccggctatcaaacactacgatactgaaggccgcgtcatctttatctcaagtttctcaaagattctctccccggccttgcgaacaggctggattgttgctgacgacgcaatcatgcacgaattggtcggactgaaatccgcaatcgatgttcaatcgccaaatgtaacactggctgctatcaacagctacctagatcaacacgacatcgacgatcacgttgcaactattagtacttcataccggattaaacgtgacgcgatgttagccgcactcgatcaatacttcccgcaaaatgtccactacacccgtcctaatgggggcttcttcatctgggtaaccttgccagaaggaattgatgctaaaaccttgctcaatgacgttgttttaccgcaagcacacgttgcctatgtgccatccgcttgccaattcgcaagtcgcaaggttaaaaacgggttccggttgaatttcaccagtctcgacgtcgaaacgattacgctgggaattaaacgccttggccacatcttacaaccggcaccagtaattgttccagcagcatcgttcgcaccccaattctaacttgacccactcatcatgcgactaaccgtaataattgcgattagtcgcattttttgattacatctgtcagctgtaatgagtggtcgtgatcctgaatattagcactttttatatcaggatccacatcaaataagccgtacgctttacgaccatttatactgtatcagtttgagcacccgcgcttgcgtcgcttttactgataaaaaagggtttgacagtccttctctgattcgctacactaacgctatactagccgattataaaataagcattggtccgtttgcgacactcaatgcttattttttgttaacagcttcattttcggataaactaggagtgttgtgaaaaatttctaggagtgtgaatcatgaagtcatgggttaaaaaattaagcgttgcagtgcttgggttaggtttagcagttacattgaccgcctgtggtagtaacactagcagcagttcaaagtctaacgacctcggattgcaaaaatcggggacgttgacgattggcttagaaggcacttttcaaccatatagctaccgtaaagacggtaaattaactggtttcgaagttgacctcgggaaagccgttgccaagaagatgggactaaaagctaaatttgtaccaacgaagttcgattcgttagtagctggtttagacacaaacaaattcgacgttgtcatgaataacatgtccgaaacggcggcccgaaagaagaagtatctcttctcgaccccttacatttattctaaatcacaattagccgtcaagaagaactcatcgattagtaagattaccgatattaagggtaagaaagttgccgaaacaacgactagcaataacgcaacggatgctaaacgtttaggtgcaaccatcaccccaaccgatagtttccaacagtcgatcgacctcgtctcacaaggccgcgtcgctgggactattaattctcgtgaatccttctatgcttacttcaagcagaatccgaaggctaacattaagctgattgattccggcgatcacattgcctcacagaaaatcggggccatcgtcactaagcaacaccctaagatgcaaaaacaaatctcgaaagcaatccaagaattacgtaaggacggcacgttaaagaaattgtccaataagtattttggtggtaacgttactgataagtaacgtaccattgcccgctattatggcgggatacatagcaccaaattctaatttgttacaggaggctccctatggattcaatctggcacatcattgtcacatcaacgccgcaaattgctgcagcgggtttaaaatataccattccgattgccattatttcgtttattctcggtttgatacttgcgattttcacggccctcgtcaagatttcgactcgtcgtggttggtttttaattctaaaagccatcgctaacttctacgtctggctctttcggagtaccccactgctagtacaactctttatcgtctatttcgggcttccctaccttaaaatcaaagggctctttccaaatggggtccagctcgacccctggactgctgggattgccactttttcactgaacaccggggcttactgtgcggaaacgattcgagcagccattctctccattcctcaaggtcagtgggaagcggcctactcgattggcatgaccaagtcacaagtactcaaacgaattattttgccgcaagctgcgcgagtctcactaccgccactatccaatagttttattagcttagtcaaggacacctccttggccgcttcaatcacgattattgaaatgttcgaagtcagccaacaaattgctgctcaaaattatcaaccacttgtgatgtactccctggttgctgccctatacgcaattctatgtacgattctcagctggctacaaggctacttggaaaagcggacgtcacgttacttacggccacttaattaggaggttgtcgaatgatcaaattagaacacttaaataagacgtttggcaatcaccaggcgttaaccgatatcaatactgaatttaaagaacaccagacgaccgtcatcgttggcccctcgggttctggtaaatcaaccttactgcggtcactaaatttgcttgaacggcccgaacaaggtttataccacttcaatgacgaaactatcgactttactaagccgttgactaataaaacaattctcaatattcgacgcaaaactgggatggtctttcaaggttataatctgtttccccatctcagcgttgttaaaaatgtcatggaaggccccgtgcaagtcttaaaaaaggattccgcgacggctaaaaagtccgcgctagaattgttggcccgggtcggcttgcaagataaggccgacgcctaccccgaacaattatccggtgggcaacaacaacgggtcgcgattgcgcgctcgttagcgatggatcccgaattcatcttgttagatgagccaactagtgcgctagaccccgaactcgaagctggtgtgctccgcgttctactagccctcgctcaggaagaagactccatgattatcgtcactcacaacatggaatttgcccgcgcagttgcggataagatcctatttgttgaagatggcaaaattctgttcgacgggacacccgctgaattctttaagcagccaacgcaacgaattgccgacttcttagccgcgatgacgttcaccacgatttcagacaaagcaaaccaatagcgttcatttgagttaacgtgcatctaactggaaaatcccagtcagatgcacgttttttagcaccccctagcgtctcacgtcaaccatcgatctggcgcattcacaacaaatggcatttagattaatataaaatgtgattttgatttgacaattgttatttaatcttgtagactagcctcaatatctaaacattgtgatgagatgagtagtgtgattgccacgcaaagcgagccgttggttggtgtaaaacggtcggacagtgatacgaagatggtctctaaatggtattggtgagcattagcaagccagtaacgcgtcgtacccgttagtgtactgagtgaattagctcattgagccaagcgttgtgcacgcgcttggaaactaaggtggtaccacgatcagcagtcgtcctttttcgataaaggacgactttttttgtcaaaaaaatatagctctacgggggtaatcgatatgaaaaaatggctcaaggcagtaagtttaacaattttaggactcgcactaacagtcaccttgacggcatgcggtaattctagctcatctaaaagcagcacttctagcacgagtagtcagctcaaattgcaaaaaagcggcacgttgacgatcgggctagaaggcaccttccagccttatagctatcgcaaagacggtaagttgactggttttgaagtcgaccttggtaaagccgtcgctaagaagctcggtctcaaggcaaagttcgtcccaacgaaattcgactccttgattgctggcctggatgtcgacaaatacgacgtggtcatcaacgatatcgctgaaactgcgcaacgtaaacaaaaatacctcttctctacgccttatatctactctaaatccgaattagcggtcaagaaggggtcctcaattaacaagatcacggatatcaaaggcaagaaagttgcccaaacaacgactagtaataacgcgaccgatgctaaacgtttaggtgcgaccgtcacaccgaccgatggctttcaacaatcgatcgacctcgtaaaccaaggtcgcgtcgccggaacaatcaactcacgggaagcattctatgcttacctcaagcagaatccaaaggccagcttgaaattcattagtggtggttcagaaatcaaaacacaaaagattggcgcaattgtcactaaaaagcacgcctcactccaaaaacaactgtctaaagcgattcaagaactccgtcaagatggcaccttaaagaaactgtctaataaatactttggtggtaacgtcacaaaccaatagccatcgcaatctatttgatagcgtccagttgatagtcacaaaaagcccggaaaaccgggctttttgtgtgtgtcggcgtctttcagcgaccatcttttatcactcattgtgttgctaaaaaccatccgggaccatttacaccattgcttatgtcgtgaacccggtcagctaattcaactgatttgcaatattgaatttcatcttgccatgattgacttccaaccacatatatttggtgttcttaggcgacaaaacctcaatatgtgaatatttttgattgtgattcttcgcgattttttcagagcggctttgcagtgtcttggctagtgactgccacgaagcggtcttgccttgatcgacactttcaataactggcgcttgctttgatattcgcacacgcatggcaccaccattccaactcactttaaccttgccatattcagctttattcgttctgatttctgattgaatattggctgcaagcgtattagcttcccgagcctgatacaaattaaatccaatctcaaagacaatgactagcgcacagataactggtggcaaccaaaaccaccacgtccgtaagctctttttttgatgatgcggctgctttaaagtcgtcgtttccgcgtctttacgcttatcctcagcaactgtcggttgtccactgccgcatttttcacaatactgggcactttggggaattcgttcaccacaaaccacacaattcttcatgtccgtttccataattgccctccgtcataatattatcgataataattaactcagccatgacaattaactgtattaatatttcaatataatgattatatatcgaaatcagtcatttttctaggccttatcagatcagtatagtatcacccttgcgtaccggacagctggtattcgctgagcatcatgattttaagctttagtacgggcctatttcagtcaccgttagcaagcacgttttgcgtttactagtggctaaaggtagtttaccttttatcattattttaatatttaagtttgacagttagtttcacttcactgtatactactcattgagcaatactatacgacgtataatatagcaggaggaatagcaatggccattcaaattagttccgagttattggacgggtgcgttttagcctgccttaaaggccaagattactatggttacgcgctaacgcagcgcttgcaagccgccatctcggtgtccgaatcgacgctctacccagtgcttcgacgactcaagaaaaatgactgggtcaagacttacgatcaggcctatcaaggccgcaaccgacgctattatcagattacgagcgccggcctgacacaattgagtgcgattcaacaagagtggcaaacctattatttggccattaaccacttacttcagggggaggatgaaccatgaacgactacttatccaaatttaacgcgttactcgttcaacttaccgatgatgaacgcgacgaggtcgttgaattttatcgcgaatacttactagacgcggcaatcgccaattatgatgactgcgttgccgaactgggaacgcctaaacaattggctcggaaagtgttagccgattattcgattcgttttaacgaaaatctcaatgccaatacttctaaacggcaaaaatctcaagcaaccgtacgcacgatttggctaattgtgcttgctttattatcaacaccgatcacaattcccgcattaatagctattttagcggtcttctttgccttggccgttaccgtctttgcattcgtgattgcagcgggtgccatcttaattggcgtgaccatcctcgcatttgccatgctaacagccggcatcggtatcttcggccagtcgctatgggtcgcactattctacctaggtagcggtcttgctattattggtgccgagctattagttttaccactatttatctggcttattagcgttattctgcaaggaattgccaaaatcgtacaaaacctataccaccgatttgttaagaaaaatcgggcggaacgaggaggtcaccaccatgcgaaggacaattagagttggcattattttattagtcattggactgattttgaccatgtttggaatcgccaataacggtattcaaagcgtttattgggatcaaggcttccatatcgttcatcataagacgcggcgctatcacgtcagtcagctaaaagatgtcacgattgcaacggccaacaatattactattaagcaaggcacagctgctaatatcacggttaccgccacgcgcgccttaccaactgttacgaccaacaatggtcacgtcactgttacttcaacgacacacaacgccaaaaccgtgggcttcatgttcgataacgtcggacaatttgctgacacgacaataattacggtgcctaaaggaactactattcatcaaataaccgccaaagctagtcaaagtggtaacgtttcgttgcaaaacgtcaccgtcgaccaattgaaaagtcttagtacggatagcgatattaatttaacggatatcaaagtcaatcagtcgctgacgttgaccggcgataatttacggttaactcgtgtctcggcgcctagtctacaaatcaatagcgatccagatatcagcatcaccgacagtcattttaccaagactgcttcaaaaattataaccgctgatagcgacatccatctaaccaataatcagttcaaagcccttaagctaacaagtagcgaaggtgatattatgctcaataataatcgcatcactgaaagtttatccgctacagccagtgacggtgatattcgaataaccgcgccacggacaaccggtgttaaagctagcactagcgatggggacttgcatattttcaatcatctccagtccgatggcggtgattaccaggtcaaccaatcggcagccgtacaataccgactgacgaccagcaatggtgatattacggttagtgctagctagtccatgctagtactgcacttactcaaattttcaaaataaaaccgcgacttgctcatggcaaatcgcggttttatcgtacttacgtttaggatgctgttgcagtcgtcatttccggacgcccttgaatcgccagcagtgctgctcccgactgaatagactgattaggttctgattctatccgttgataatttttactatttgtcacaatcaccatgaccgtgtcatctaagttagcagcttttaacaccgttgagtcaaactcacctaagagatcacccttttgaacagtttgccccggtttaacgataactttaaagccttgcccttttaatgacaccgtatcaataccgatgtgaatcaacaactcaactccattattggttgttaacccataggcatgtcctgtatcggctacaacactcatctgaccactttgtggcgcacagacttttaccggcccctgttcctgtggcttaattgcaatgccgtcccccatcatcttagatgcaaagaccggatcgttaaccgtactcaaggcaatacttttaccagaaactggtgaaaatatcgtatcatctacaatctttggttgtacttgatcagattttaatatgtccttaggaatcgcaaacatattagtggcaataaaagccactgctaccgtcaataacgagacgaccgtataaatcagcaaatcacgagcattgtaaatatacatcagataagagggaacaacggctagaccatatgaatttgctgccacactcataacactcagtacgccagcacctatcccactggttaaaacggttacaaccaacggcttgaaattatagcgaatcaagaccccgaacaaggttggttctgaaacaccaaatagttgcgaggaaaatgcgccaataaaattagccttagccttttgtgactttgctcgtaaaatcatcgccaaagctacccccagattagcaaagccatacatggcttctaaagtaattaacggattgagcttggtagctgctaatagtgacgtttcgatggcaatcatcatctgatgaataccaactagcaccattaacggataagcggctccaatcaaaaaaccaccaattccaaatggtaagttaatcaacccttcaacaccactaatcatcacattttcaatccagtgtacaaccgggccaacccctaaaatcataataccaaaagtaactaacatcgttaaaaagggcgttaaaatttggtcgagaacgttagggacgtgtttatgaaagtaatgctccagtttacttccaagaaaaccagcaactaacgctgttaatacggatccttgactaccgataactggaatcttgtcaaaaagcataatcgctttcgctgtaccacccgcaactgaatacgcgttaggcagtgaaggggaaacgagcattagtccaatcacaataccgacaattggtgtacctttaaaatagcgaaatgtggaccaaacaattaaagctggcagaaatgaaaaaacagtccccgttaaaactgaaattactgtattaagacttgccggaatcgcggcagatgaagttccaaacaactgtaaaacctgattgttagtcaaagcactttgtaatcccaagaaaagtccagtagctgcaatcaccggaataattggaataaagattcccgaaagcattgccatgaatcgttgcaatggtgacttctgattatcaggagtcggcgtagtcgtcgtttcctgactataaattgcattaactaaatgtaacttttcaatcgcgtcatacacatcgttaacaacaccagtgccaataatgacctgatactgtcctgaaccgaaaaagactcccttaacctcatctaagtcttcaagcgctgctttatcaatctgcttaggatctttaacaacaaaccgcaaccgtgtctgacaatgagtaaccgattcaacattgtcaacaccaacaatatcaataatttttttcgcaagtacctgatagtttttactcatttgaattcacctcaaaaagaatggcttgatatggttccaacgtattgagtcgataatgtgcgtaattatttaatcgaggtcggccattaggtaacgttagtaataaccgttttgcgcttaagttaacatacacctgtacccttcgaccacgttgataagcaatcacttggtcacaatcacaagtaattggcctaaaatcaccgactattaaatcctgatttaaatttgatatttgccgtaacttaatcaatgactgataaaaatgccaaactgaatttgaatctaattgttcgctttgccagtttaccctatcatgtgactgttttggtgtaatccatggcttggcaccctgattaaagccttgattgacggaatcatcccatggatatggtaatcgcgcattatcccgggaacgagcatttacaaaggcaagtgcctcgcttgctgaatatccctcttcaatagcacgatcataattatcgtgactgctcaagtcgttaaacatggtgattgagtcacgccgtgcatttgtcacccccagctcttgtccttgataaataaatggacaaccgcgcaagttaaaataaagtaaggctagtgctttggcaccaatttcattccgataagctggtgtctgaatatatttatcaatactccgcggctgatcgtgattttcaaaaaagttagctccccagccgacattttgaatcgccagttggcttttaaaaattgcgcgccgtaagtccgtcggtgtccacttaactcgtcgataccactctgatccggatgcaatatcaatatctgcgtaatgaaagtcaaaaatcatcgagaagtaaccttttttaccaataaattgtccaagttggtcataactaacccccgaagcctctccaaccgtcaccgcgttagctggtttaaaagtagccgtgttcaattcagctaagaacttttcaataccaggtcgattttcagctttacgtttgactttacctaacccatcaacaccatcaggactaatgctggcaaaatcttgatctttttttatgaatgttattgcatcgatccgaaaacccgcaaccccttttgccaaccaccaattaatcatttgatagattcgtttccttagagccggattttcccaatttaggtccggttgttgtttagaaaagacatggtgataatactcatcctgacttcctggcaataacgtccatgacgagcctttaccaaagtttgatcgccaattattaggcggattgccgtgtgccccacgccgaataatataaaaatcacgatacggactcgtcggcgatttaattgcagattggaaccacacgtgctgatcagaggtatgattgataaccaaatctaaaatgacttttaatcctaatcgtttagttacttccatcaactcatcaaaatcagccatcgttccaaaccgagaatcaatagcttggtagtcagaaatatcgtaaccgttatcaaccatgggtgattgatatattggagataaccagatagtcgtaattcccagctgtttcaaccggggtaacatttggatgattccacgcaaatccccaatgccatcgttattagcatctttaaatgatgccggataaatttgataaaaaacttctttttgccaccaatttttttgcataattactactcctatatttggaatcgattccactttaatcaaaagaaaaaggcttaagcactttttcttttgattaagtctaagcttagatcaatcgttaactcaggtcgttgtaaccggcccaagtgatgtaatagctgatcgaccgccaattgagccattgccgcgaccggttgtcgaaccgttgttaatggaacttgggccaccgccgcaaatggttgatcgtcatatcctatcacggccatatcatctggcacgcgaaaatgttgttgctgtaactcatcaattaccccaacggccacctcatcagaatttgtaaacaccgctgtcgggcgatcactagggtttaaggacgctaattgcttccccaacgcttgtccatccgcaatcgtatgttgttgtgcgaaaacccagctattgtttacaactaactgctgctcttcacaaaaatctaaataggcttgcgtccgcgaacgtccatgatgcgtactgggaaaatcaccacccgtggcataggcaattcgccgatgaccttgatgatataagtatgccaaagcatctttagttgcctgataatgatttaaactgatcattggaataccaatatcagtagcttcttcattcaacagcaccatctgattagcatatgtcgccgacaattgtgccactagttgttgattttcaatggatgccagaatgacgccatccacttgttgctgcttgagtttatccagaaagtgttgttctgccaacgcatcatcatgagtctgcattaccatcacttgaaacccgtatccgtttaactcccgttccaatgcatcaaataactgtgcaaagaaggggttagagattcttgataccagtacaccaatcgtattagtgctctgcgcgcgtagctgactcgcaatggcattcggggtgtaatccagtttttcaatcgctgcctgaatttgcttcttcttagcaactgaaacactaggccgatggtttaaataccgtgaaacagtcccaacacctacaccagcctcagctgctatttcactaatcgttgtcatttaagctcaccccctatttggaatcgtttccacaattaatataacgacctttcaagtaattgtcaagacaaattggtttttcaaaatgaattcactaaaaacgtttgcccttaaaacatttagtccaccagtaaaaaaatggaagtatcctgccatttcgataacttcatttttaacattccagccaaaaaaatattccaagccagtgtgcacctgacttggaatattttaattactgattcagccttagtaatcgctataacgatgcttgatagacatcaaaccacgtcaataatagcgacacaatcaagataccaagcatcgccaccgcgtgccaccatttatttcggacaaatatcgcaatatactcacgaatgatcgcatccggtaagaagaatcgcgccgtccgcgcaccaataccatccgcttttagacctgcttgcttggcaaacatcccggctctaaaggtatggtaattatttgtaacaaaaatcgtgcgtggatttttaacagggccctgtgcaatcaattgcttactaaactgcatattttgcaaggtcgtcttcgattgcgtctccgcccagccatccgttgcaggaaggccatgcgcaatggcgtattccagcatggcttggccttccggaaccgtttcatcaccaccctgaccacctgagaaaatcatcacggcccgatgatgcgtcttgcgttgttgcttctgataaaagcgcagtccacgcatgattcgttgccctagcaatggcgagacacggtctccatctaacaagccagccccaagcacaataatataatcttgtcgcagacggggccaattgaattgataaatcgtcagcatcgtcagatagttataaaaccaaaaaccaaggtaaaaaatgaccagattcggaaataccgtcaaaaaataactcacgggctgcggcacatgactactcaacagattgcctaaaaatggcaaaatcagaatggccagtcccaagtacaaggtcagcatattcgccaacgtatgactctcatgacgccacatgatccacgcattccataagagcaagaaggcttgtaaggtaaaaatcagcccaatcaacaggatcagcaacacaaacaacgtcccactgataatgatcaaccagtggatattgctacctaaaattgtaatcgccagcatggttaaaaacgaatagaaaaatagcgaaaaccaaataccgttacctaggcgaaccttatcgcgatgataacgccaaccaaaaatggttccaaatatgagtggtactaaccagccccagtaaaacattgctggaactggaacccaaaccgctgcgtcattcacatcaatacccccgcattaagttttatttcagcttccatcataaaggactccccgcgggactgcaatcaggagtcattacttcaactgtttttgttcattatagaaattacggtaagctaaatagcacgcaatgattgaccccaaactagtcgctgataagagcatgaacgtgaccataatttgatacttaatggcccgtactggatcgacccctgcaaagatcaaaccggacatcatccctggcagactgactagacccacagtctttgccgaatcaatggttggtgacatccccgtacgaatcgcctcacgcacgatggcaatcgaagcgtcgagtagaccagcccctaacgccaaccgttcaagcacaccttgccgctggtcatgaaactgactattgaggctgcgataagccagcccaattgcgaccattgaattcgacgcaatcataccagaaatgggaatcatttgcgatggcacaaacttaatcgcaccagatagcacgaggacgccgagtgttacccccgtactaacaaaaatggctaataacgaaatggctaatgcatggtcaatccccggcccccgttttttcgcattccaagccgcattgaagataatgaagcccatcatcgccaacgttagccacaaattgttgactcggaaaatatactttagcaagtaacccacgataaatagttgtacaacagcccgcacgacaccaatgacgatgtccttatccaagccaagtttctgccacaaactaattcctaacgcgacgagcactaacattgccgccaaaaatagcgacgtattattaactgctaaattcatgcatgtacctccaatctgccagcaaccactttcgctaattgatctgccgcagcaatctctgtcgcgtcatgagtaatcatgatcgttgtcacgtgatcctgctcatttaactgtcgtaaccaggcgtgcacgatttgcttattattttcatccaaaccagctgtcacctcatctaataacaacacttttggtaagaataagatgttgcgaatcagcgcgacccgctgccgttcaccaccggaaagctcggtaatcggctgatgcagggttcgttcggacagcccaacattatttaacgccgttaccactcgttgcgtatccatgacttgcttacgaatttggtacgggaaagctaagttatctgccaccgtctcaccaaatagcgtcggctgttggaaacaatatgagacttgccgccgatacatgattgggtcatagctttcaatcggctgcccatcaaaaatcaaggtcccacttattttagaaatcatggccgcaatgatccgtaataacgtgcttttcccaccaccggatggtcccgtcaatgtaatatgagccccagctgaaatctgccaatcaacatcatgtaaaatatgttgatcagcgatttgataattaactttttctaaactaatcaatgaattcatatgcccacccccgattactaatttagaatcattataacctgactgttaggcgactttcaaacaatcctcctcagttatcctgtgtctttccacatgctataatggaggttaacacagttcacagaaaaacgaggtcaaaatcaaacttatgccacaatctaatcattattcgcaccaatcccgatcgcacaatgatcggcgccgacaacagccggatgaaaaagtgcaagcgaccgttaacatcggccagcgttttccactgaccattcggcgtttaggcattaacggtgaaggtattggctattacaaacacgtcatcaccttcgtcaagggcgcccttcctgaagaagtcgttgttgctgaagtaaccgccgtgcacccacgttacctagaagctaagattcgtagtattcgcaagcctagtcctgaccgggtcgatccccgcgatgcctatgcgggcgaagtcggtggttttgaattagaacacctcgactacccggcccaattagcctttaagcaagatttaattcgtcaagcactcgaaaaataccgcccagctggttatcgacactatgatgttcggcccaccattgggatgactaatccttatgaataccgcaacaaagcccaatttcaagttcgtttaattgatgggcacgtcgctgctggcttatataaagaaaatagtcatgacctagtcgacttaccgacctgttcggtgcaaatgccggcgacaatgacagtcatgcgtcaagtcgtggcttggctggaggaactccaagtaccgatttacgatgaagaacataattctggcatcgtcaagacaatcgttgtgcgtgaagcggccgccactggtgaaattcagctggtcttcatcacaaatacacccaagttaccgaaaaagcatcaattattgatgaaaatcgctgaaaaactgccaatggtcgtgtcggtcatgcaaaatatcaatgctggtaaaacttcattgatctggggtgaccaaacaacattactggccggcaaaccaactattacggaggagctagacggcctagtcttcgatttatctgctcgggccttcttccaattgaacccgcagcaaaccaagaaactctatcgcttagcacgcgaagctttgaacttagcgcctaatgagacgctggtcgacgcttattcgggcgtcggaacgattggtttatcactagccgacgtggctaaggaagttcggggaatggataccattccggcagccgttgcagatgccaatgccaacgcccaacgcaatcaaatcactaatgctcattacgaagttggtgaggcggaagtcttgttaccgcaatggttagcgagcggttttgcgcctgatgcaatggtcgttgatccaccccgtactggtttagataacgtcttaattgatgccatcttacaaagcgcaccggaaaaactcgtctacatttcatgtaacccatcgacgcttgctcaggatttacaagcacttacccgcggatatcaagtcgactatattcaatcgatcgacatgttcccacaaacagctcgttgcgaagccgtcgtccgcttcacgaagcgtcattaatttgccactcactgccaatcatatgagggggaatcatcatggcagctactgatagtcaaattgcattaacgatgacctttacgttacggccaccattcaagactcatttcttactattaaaagattacgtggcggatgttcgtatcccggctcgtgatgggatgctaacgacgattattgccaaaaacattccgctatcaccggccctagagcaactaaaaacgatttttgatgatgtccaaaacccagtttactggcgcttacacgaccaagccgttcaggaattcttcagtgcgcatcctgaacagcgaccggtcctaccaatcgacttgctgcaagtcatgctcaatacattatctgcccaaggtttgtccgatcaacaattaatgcacattatgaaagacgtttttgaacggctacaaaccaatgacttcaacggacaggcatcacagcgaattttgacgtcgttgaataataagtaaacgccaccatttatcgctgacttttataaattaggattagataacaccaagttgtctaatcctattttttcggacataaatcaatagcggtgaaacttcattagtcacagaaattcgcactaatactcgtttttatttttcttagccattcattaaatgtcagcatacgaaaattgtcttttcggttattggaagcaaacttgttgactttgaagttacatgtgataagctaatcactgtaatttttattgctacagcaatttgaaaggatgttttaattatgaaatacgccatcactgccgctactggtaaatttggtcaaagcgccgttagtacgctgaatgctaaagttggtgcagaaaatgttttagtaattgctcgtaatcaggacaaagctgctcagctgtttcctgataatccaattcgtaccgggaattacgatgatgtcgactcaatgacgaaagccttcgagaacgttgaacgcgtgctcttcgtttcatcacaacctggtggtcccgttgaccgggccaccgctcataaaaacgtcgtgactgcccttaacgccgctcatgttaaatttgtcgcctacactagttttcccaacgcacaggcagcagtcagcgccttagccaatgatcatcgggccaccgaaaatgccataaaagcgactgatattgcgcacagttttcttcgtaacaactggtatttagaaaacgaaatgggcttcttacaaagtggtgcccataaccaagaaaccttgtactgggctaataatacagctggctgggccttggaacgtgaatatgccgaagcggcagcaaccgttttgatggcagatgcccctcaagaagtgtacgaatttgctgggacacccctcacttatgccgcactcggtcaagcactccaagaagcaactggcaaccaagttaagattacccaagtcagtcaggatgcgtacgtgcaattccttgaaacgactggtctaaatcatgataccgctgctttgtttgcctcattccaatccccaatcaatgatggtgcgctggctgaaaagtcagccgacttagctcatgtcttgggacgtcaaccattggaagccagtgtagctattaaagaaatcttagcgcgctaataacgagctagctgtaagtttctcttaaatatcttctacaatacgaaaataggaagttcaacgaacatggcgttgggcttcctattttttaatgattcgtaaatggccttttaattagcgcgtaacatcagcaaaatactgagctaaggttagctgaataccattatgattattatcagttgttactatgttcgctgcctctttaacgggttgtggcgcattagccatcgcaacaccaatccccgctgtctggagcatcgcaacatcattaaagttatcgccaaacgcaatcgtttcagcaggggtaacttgatcatcctgtaataatttcattaatgcggctgctttagttacgcctgccgcaacgatttctaaataagtttctttcgaacgataaactgctaagccgctaaattcatcacggcttaatcgttgttcaatcgcctgaataatatctggatcggccatgatcatcattttatgcactggcgtcggcatccgttgcaaccatgtgcccaaatccgtgacatggggtgcataaccaattcccgtcgcttcctgctgttcccacgggccattagtagccaccaaccagttattattcgaataaatactaattgaggcagctggccaatcatgagctactaccgtttgcacagcttgtgctagtttagggtcaacggcttgctcttcaaaaacagttagtcgatcattcacatcggtcgtagccgttagcgcgccattataggcaatcatggtcgaattaattcctagttgttgtgcaattccaaacatccccttaggcgaacgtgctgaggccaacaccatttgtgccccccgtgcaaccgctgcttgaactcccgtaattgtagccggtaataactgtccttgactgtcgactagggtaccgtcgatatcacttacgattaatttgatcattgattttcctccgttaagttaatcatggctatgctaagcgtagacttatattatgtatccttatagattctactgtagcatgaatcaagtcataaataagtattccagaccatttttcattcatagtaaagtaaaagaaccgataacgttacttgttatcgactctttttacctaaaatatcaaatttttggccagggcgacattaccaatcgttgcagaaccattattagcaattcccgttaaaacaatcaaatgatctaagttcggtaattcaacataattgttattaagctgctcaacgtctcttctaatcactggaagttcagtttcgcttactactgagccaccaataacaattctttcaggcatgaaattaagatatgcatcaaagaccagctgtgcaatataataactgatcaacttaaatacttcattggttcgcttcaattgttcccccggtttgccagttcgagcctcaattgcgggtcctgaagccatgccttcaaagcaccgattttgatgatatggacagacacccttgaagttatcgcctgacataggtatgaccattgtatgtcccatttcaagatgagacataccacctatgaaatgattatcttggataacaccgccaccaatgcctgtcccaatagtaaagtatactagtgaacgcactgcttgtccttgtccaatcatatattcaccataagccgaagcatttacgtccgttgtaaaagtaattggaattttcaaagctgccctcaacatctgtacaacatccgtatgagaccaaccagcttttggtgtatttaaaatctgaccatatgtcggtgaatccaccttaatatcggctgggccgaaactcccgattcccaacgcatcgactggatttttcttaaaaaatgaaacacaggctgccagcgtttcatttggctttgtggtcgctactcgttgtcgcttcaagatacggtagtgctcatcagtaattgctaaaatgaacttagtccctccagcttcaatacttcccaaacgcatgagctatgccccctgattgtgtatgagcaaggtaaccatatcataaggctgaatcactaattgttccgaacatggttgagcctcttccagagcatttacctgaatgaaatgttgttttaacaagggggtcaaatcagcagccacaccagattcatttgccaaacggataacaaaactatttggcacagtataggccggatacaacgcgctaattgtgacatgtggatcgagtttcaaaaatgactcgcactctgagatagttggtaatgaatcatcaaattcaacatcccaaattttattgtctaatcgatttacaaataaattcaatttttgtaattgataactaacatcgggtgctaaccacttttcagcaattattgccaatttattttcattcaattgagacgtggaaactaacccaaactcaaatgtatttgctcctaattcttcggccaacggcgttggtgtcatctgatgcccaatactagttgtatcgcctgaagcacgacctggtcgccacagtaaattaggcttaccaagttgaccagtggttgccattaatgtgacataaaatgctttctttcctaactcgtattccttcattcctttagcaattaaatacaggccatcgctagccccttgcatcccgacaattttatcaaagttataaaggttaaccggtttttcaacaaattcttcttcccaattttccgcaattggtaaattacgtgttctttgaaagccgccttgaacttgcgcaactgcagtgtcactttcaattgctgtattaatttttaaccgtaatcgatgatctagaacctgattatcgacagttaaacgacctgccaatacattgtcaccatcagttaaagtcaacgttaattcaaatgcgacatcgtgcagctttggttcgtgactaatcctgtcagccaagccttctggtaactgccacttgccgcttaatcgcagttcttgccttccagctccaacataaatggctacaacgccggctaaaggcaagtcaacctctttgtcgcctcgaagcggtgaataatcgtacgtatcaccatcattacccgaatctacaatactaatgatgtttttgtaagttttcccattagtagttgcctgaaagttgccatcgacataattcactttccaactttcattttggatagccgtttgttgctcagactgtaattctggcaaagcttctgcaccatccttaaagtcaattacttggtagcccaacccatcaaactggactgcaacttgtacttgtaattcatagtaaccaggctcgtctttaaattcaaagcctttagccgtttgttgcatgatattttctcgcttagccacataatttgcacttaaaatagttgcttgatatttttcatcaaacataatgtttttcgatgatgttaagaaacggattttcttatatccattgaatgggcgtggatcagtattgaatacaagcacctgattggcatccagtttcaaccgttgtgcgattcttttcttgatatagttttcgataccgtctgcaatttcaaaaccttgtttgaatcgatggtcaatatcaatagcaacattatcagaaacactgccacccaaactgtcatgcggttgacattctagcaactttttccaaagtttcaaaataagacccttagacacatcgataccacatcttttggcgatgaccatcagtggctcaacacgtcgtaatatttgctgttcgagtttgaaattctgccgtttaatgcgcgaacgtactgaaccaattgtccgatgaactctagcataagttggataccgcaactcgccttgataatccggtaaatcgttgcgttgtcgtaatgttcgcataaacttcggataattgctgatcacaatctgattatgactatatttatttatcttactaatagtctcagatacgttatgaataatattcatttgatcgattcccgaaggcactaggaccgaattattttgaccctgttgactttcaaaatcaattcctggatctagacggtttgcaacgaactcttgtaagtttttcttcgaatccaatgcgatttgaccagtatagtaacctaacggaaaattagcagcatagacttgactatgacctagactgtgccatttaaaataaacagagtccatttgtcgcttaaaattagtgccccgccaaaaaataaagtcattaatgccaacttgatttaagagcattggcaattgcgaattaaatccaaaagtatctggcaaatagccaatcatcattggttgcccatacttttgtttggtatcgttgatgccaataactaagttacgaataattgattctgcatcaggtatcatcgcatcagtctgtgtataccatggtccaacaaataattgattacggttaattaatttctttatccggataacatcttcgggatgcatttcaacatactcatctagtattgatgtctgtccgtctaaagtaaaattagcttcaggatgcgtttctaactccttcaaaacatttgagaacagctgatcacttagcacctgtgcgtcctcagttgtaaaataccattctcgatcccaatgagtatgatttacaaaatgtgcttttgtcataaatgtatcgctccctgttattttaggtaacaaaagccgcactacggctctttaaccattatgcggctcgttttagtcaatctaagcttcaaaattaatgttaatgtcgtcctcattatcatcagtgacttgttcttcgctctgtgtttggttaaagtccacagccaatggtgccagtacaccgataatcgcagcgcaaacaattagaccgattaaataggcccaaccattcgtaatggtgacaaatccataaaccccaccaacaggaggaatcttagcctgagccccaagtaaaatcgtagtcgccgaaccagcagcaccagcaatcatattaattggaattaatttcaacgggttaactaatgtaaacggaatagcaccttctgttattccaataaatcccatgaaccagtcgcttcgtccagcatcaagtaattcatcagaaaaacgatgcttaaagaaagtcgtcgcaaatgcatatcctaagggaataccagcaatagccacattaacgatcattgcaggggtgtaaatcttttcagctaataaaacgtttcctgccatccatgcagccttattaacaggaccgcctaagtcagaaccaatcatagcgcccatgataactgctaaggtaatagcacttacaccgcttgtactcatttgtttaatccaggcgacaagtgatacattaatccaagtcagcggttgcttcaaaatgactcccatcaatattgccacaaccattgtagatagcagcggtacaacaactaatggcataatagattcgaacttttcaccaacatgtaacttattgtgacaccaacgtgcagtataaccagctgcaaacccagcaaccaaggctcctaaaaatcccatattagaactagatgctaatgagcccccaatgaacccggcggctaaagctggcttatcgccaatagcatatgcaatgtaaccggccaaaactaaattaactaagccaacaccaatccaaccaacggcttcaatttgtcccatataaaaccaaaaaccagttttatacgcatcaaaacttgtaattccaaaacatagacctatcaacttaggaactgcaactacgagggacccgccaataacaaccggtaacatatatgaaataccagacattaagtagcccttccactcagccaatattttcttcataactcactcctccattcttcattaagttcattttatttaacacgagcagcaaccgctttgctgaccttatcaataacagctttcggctttttaatacacatattaatatcaactcgaactgctggaatcccttcaaatcgatccatcttttcaattttttgatccgaaccaatcaataaaaactttgcgcttttcgcctcttcaactgtaatttcatttttaagtcccattgcaccctgttgttctactttagcttgtaaacctagttcctgcgctgctttttctagcgctttcgccgccattggtgtatgtgctaaccctgctgggcatgatgtaattgcaacaaaatccatatcagtcatcctctttttataaaattttttccgaactattggttaatacagtgtaaacatcctgaactgtttgactttcaagtaatgcttgacgctcacggtcatccactaatgcactcgcaaagttagctagaatctgtaagtgtgcctgctcactattttttggaactagcatagcaattacctgattaactggttggtcatcaaatgtcggccaatcttgaatgcttgttgtagagcgaatgaatagtacagcaggttgccgcagatattctgagattgcatgaggaatcgctataccgtcctgcattcctgttgaagcttctttttctcgttgatacagcgctttcaaaactgcatcttcgttatctgcaaagccaagttcaattgctttatgtgcaataaagctaaaaacatcctcacgtgttctaaaatgttcttttaaaaaaatatacttctgtttaaaaatttctgtcatatttgcatttccccttcactgctgtgctaatgtatcaataatttcttgagcattttgagcctttattaaggccgtcattcgctgcccatcttgaatcaaattatagaaataactgtaaatatcatccatttgtgtttcaaccgtgcgattcagggctacgaaaaatacaatatggacattttcgtgatcccatttaattccctttttcgacgtcatgattccaatcgttggttgcaaaacatggtcgatatcaccatggggaattgcaaatttatcgataatggtggatgcaacttgttcacgtgctaacgctgaattttgcatttgattatcaacatacccatacttttctagccgatcagttagttgaataatcgccatctttttttcagttgcctttgaatttgtaataataccgtttggacttaataatttaacaaatgcgttccgcgtatacttttcttgacgaatatcttgacttaacttttccaataagctgagttcttggtcattcaaaaacggactgacttgaataaccctcgtaccgctcatctttaacgggatagtcgaaataataatgtctgcagtcactgttgaagtcatcaactcattcacagacaaagtgccaacaatctgaacatccggtagtttgtccatgacacgttgctttagtaactccgccgtaccataaccagtgctgcatacaattgcaagctcaacatctggttttaagatctttcggcgctcaatgaacgattcaaagtgcagtgctaagtatgcaatttcatcctcagttagctgtaaatggtattgcttttcaatcgccatcgctaatgctagtgcttgatcaaaagcgacgggaaaatacgttttaacttgattacaatacggattcgtaatactaatgccatttttaatgcgaaccagcgccggacgtaagtgtagcgttagattacgtaataattgattatcataatccgttagcacgctacgtagccagtcgactatcgttcgttcaactaagccacttctatccagatcaatgtacccatcctcaatggccgcgacatgcatatttaaataagcaacttcttcatcgggaatttcacacttgaaggccacgataagcattttaactaatttgttggtactcgaagatattgccatagtgtcaaaattctgtgtcgtcgtttgagtaataaactcgccattcttaattcgctgaatcgcaatagttgtatggatcagtaaagactcatattgatattcatttacatcaacttttaaaatcttcacaaatttattcaggactttttgcatctgatttaaggtttgtttattgacatatcgtttcagggactgcggcactttaaatgtgcgtgtcattttgccagtctgttgattttgcttaatctcttgtccccaatatgactgtaatagctgaccaatcactcgacgaacatcactctccgaactattgaatttaacaccttctgtagtggccgtcagcttcaacccataatccatttttaaaacatttaaatcacgttccaacgtactacgactaataaagaagtggtcagcaatatcatctaataacactggtttagattgctgtgtcaagaatgtcataatgctaattctgcgttcttgctcactttggctattatccttcagtatcggaaactcagccaacagtcccttcgtattaccactaaaacgaataccctgtcctcttttcctaacaaggtgtacaccttgttggttgactaccttttccacctcattcagatacttagcaatcgtcttacgagatgtgcccgtatactccataatatcttgatagtgaactatcctttttgacaatatcaactcaataatcattcgtgtaagagttgctggtgaactattcggcgccaaatttatcactccctaacttttacaattcatatgataatgtaaccgtatacattatttaagctcataaaagtacacttgtagctagtgtacctttcataagttattattctttgtgctgtcggccatatacttgaagattgctttagaagtttaatctcgaatcctattgtgactaatattaccccgattttgcgcgttatcttacaggaagacaaatcatttactgaattaattaactattgatatcaatcataaaaaagcagcgtgatttcattatcctgaaatcacgctgctaagactatccaattacaatattcctcagaacagactagggtccgtcttaaaactacttaagtaagatgcaaattgaggcaatgtagaccgnnnnnnnnnnttttcagacagtccctagtattaactctcattatcaaatggtgcctaactatctggtctcgaattatccttcaattcaaacttaactttatcccccacgagtttgacaaatagttcctggtcaggctgaggatcaaatggccccaagtcgacaagaatctgaccattatccgccacttcatatccttggtaacgatcggcaagcagatgatagattgtttgggctggtcgcatccgctcatccacctgagcggccgccgccttcaaggtataaccagtctgcaataaattactcatcgcggctgccttgataaccattttcattgtatacacgcgagcctggcccggctcatcctcgttcttaggaataatgtacccctttttttgccaataccgtagttgtcgtggcgagacaccagtcattctgcttagttcactaatgccaatagttaattgtcctttatgaaaaagctcacgtaaatctgcacgcgtcccgttagtcatactggcgactcctttccaaagttgctattgatataaattatagcatggaatttcgtcgcgaccattaactcgcttggaattttccgtgattaattaacttttctgataatttgtttgtaagtaatccagcaatgactgggcgggacgatccataatcagctgataatcatcacttactgtggctaatagtccgcgggcgccaccggcatacatcgaggccaacattggcccctcaccattctgattgtacatatcgctgaaggcttgcaaggacactggtcgatacccgattggttgcccgctcacctgactaagcacagtagcgagttccggcatcgtgtaagctcgggactgtgttaacgtatagattcgaccacgttgtaataaatcaggcgttgtggcgactttagcaaaagcggccgcactatctgcctgactgatgaagctgagagcctgatcagccattggataaacgacgttgtgccgttcaattaattctggcaaatatggcactaacggatccgcgtaaagcgcattccggacaatcgtatagttaatatcacttccagctaatcgccggggcacgtaaccataaaatgctgataatgcaaatggattattcacctgatcggcaatgaaacccatgactaggaaatgatgcacattcgcctgttggactgctgctaagacgttctcaaattcttggacccgcgaataactatcatgactcttactaggaatatagatcaggacatcactgtcttggaaaaatgcgcgtaactgctctggctgctggtaatcaatagccgcaacatgcaaaccttgttgttggtatacctgggccttactgagtgtatggacccctaaatataattcagtggtggcgactaacggtctcatcgcggcaacaatctgttgtcctaaatgaccagtggcacctgtaatcgcatatttcaatttaactcgccctttcatgtaactttattagttacatttaactaaatatcgatatatttgtcaaataaagcggccgcttatgatattaacgtcacccattgccgccattaattcggaaacatttcgtcgctacatcgttaaaattaaatacacagaaagggctaccctcattacaagagcagccctaagaaatgcttttctaaaaatagttaagccctaatttgcaacctgttgaccaaggtgcttcttttcaggcgccttcttaacgtttttgacatcattatcggaaaagccaaacatccacgttaacgtaaaggcgacaatcaagtcgatagcagaggcaatcaagaaaccgtagaaactaaaatcaagccccttaggattgatgaaggaggtcacaccgatcaatgatccggcgaagccccacatgttaacgttaaacagtccggtcaagaaaccgccgacagcaccaccgatacttgcagtaataaatgcccggccgtatttcagattgatcccgtacattgcaggttcagtgaccccacagaaggctgagatcgttgctggccaagcgagctctttaatattagcaaacttagacttcagcgcaattgctaagaccgcgccaccttgggcaaccatcgttgcagaaacaatggcattcaagtaactgtgcccagttgtcgtaatatcgttgacaacaattggaataatcgcccagtgtaacccgaagataactaatacttggtagaagccaccgataattaagccagagatggctggactgagtttgtaaatcgccacaattcctgcagccaatgcgccagacaaggctgtaatgattggcccgaggatgataatgatggctccagaaataatcacaacttcaaacaacggtacgaagatcatccgtaagactgttgggatgacccgcttgagccatggttccaacttacttgctaaccacgcccccgcaatcatcgggaaaatcgagtaggtataggaggcaacgtgaaccggaatgccaaagaagttcgcattgattgccattcccaataagtgacccgtaacctttccggttgttgccatactaacaattgctgggtatgttaagaccccaccaataattcccatgataaccggatcagcccctaacttcttggctgcggtgaaaccaacaaatatcggtaagaagtagaagacggaatcacccatcgcattaataatcacgtaggtcggcgttgtcgcagagacgaggttgaagttctttagtaacgacaaaatcccctttaagatcccagaagctgccaacaacccaatcactggaatcatggatcccgtaataataccaatcaagctgctaaaaccgtatttgaccttctgccacggcgtcattttctgccacgctacccggttcgcttccttctccattgcaacagccgaagcgtcagcatccccaaagcctgcgcctagttgacccacgattgcatcatacacgtcggtcaccgctggcccaatcaccacctggtactgaccacctgcctttgcaacatcgataacgccctttaggtttcggattacctcgtcattggcctgcccttcgtcctttaagtaaaatcgaacccgggtaatgcagtgaatcacgcttttcacatttaccggtccaccaacttgagcaatgatttgagtcgccaattcatcgtacttgccgcccttacccttaaccaccgatgcttcggcaacgtgttctttcaattcaacaacagcaccgacgaccccggcacggacttcacccagttcgggcgttagtttggtaaccatatccgccgtattcgttacggccatgattaccgtggtatccttgttcgcactagtaatcgccgctaaatccatcacggccactttttcgccggcctcgaccgtatcaccaacttgcacgttaactttaaacggtggccgatctgctagttcgaccgtatcgataccaagatgaaccaacacttccagaccattgttccccgtaaagccaatcgcgtgcagactcgctgcaaccatcgttactttaccactgattggtgcaacgacctgtccatctgtcggttcaataccaaatccttgccccatcatcccttgtgaaaacaccggatcgtgaaccgattcgagtggcactaactgtcctgcaactggcgttaataaatgcacttgcttcatagcgattctccccctttgactaatcaataatcgcgttgttaacaaactaatttcggacactggttgttataaaatcactaataattgccaatccatccagtgaccaactgtcaggccctcctaactaatcaagtaacgcccttaataataaaagcgctttcttttataaacataataatagccgcccctattaagtcggtcaataaaacccgattaaattaaggcggttcacttgaatttaggaacttatttaattagtttgccaaactttgtgaagcaagtgttaatctttgcgttgcaagaaaggaccgttcgaaatcagccgtcgttttgacctgtttaccgaaatcaacaatcagtgcgtgccactcccaagccgtcgttaaatcataatgccacgcctgcataatcagttgttgggcctttaagtagttgctcggtaacggttggttaagccagccgaataggcgccgcaaatacgtgtcaataatgatcgttggctgatgaaaaacgtacatgctaaagtagtcagccgtttcatcgccaataccgcgcagggcgattagttcacgccgcaattgttctgctggcaaggctcgcatcacggtcaagtcaaaatcatactgtccacaccacgctgctaaggcttttaaagttggaactttgcgcgtatagaagcccgcaggtttgactaaagtcgtcagttcagtatcagtcaatgctagtaactgccgaggctcaaagtcagtggctgcttttaaattagccagtgcgtaatccacgttgcgccagttggtattctgaacgagaataccgccccagagaatctcccaaggcgtctcggcaggtgggattccggcttggagccagtgccggggccccatggcagctaacatctgctgatacagtgtctcaatggtcattgttagccctcctcacatgaattgattaatgttgagaccaataatttgatcttacaaaaaaatagtcgtaacggcaaaacatcaatccgctacaactattgtttacgcttgtttattagtcatctaccaccgtactgcgcttaacagctagcacaatgtcagccttccgattttcaggcttgatcttttcttcaaagtccaattcggcatccttaaacaggttctgaatctcagtattaactaacgacaagtcgcgtgaatccccagcttgttggcgaatatagaccacatattgatctggtaattcttcaagatcatattccacatcttcgtcattcaaaataacataaatcaacttacgttctttgttcatttgaaacttccccttatcaattattttatccgaattagtcgtttgcggctaactggtgagcaaacttaaggtagtcagccacacaatggtctaaccactcaacgaccttattgtccgtaaggtcccaatcggcattcatcttgtcctgcaccgcgctcaacaagaattcatttccaggcagaatctgcatcccaactccgggtgaatctaaaacttgccgtaaatgactctgcgctcgcactgtccccaagggtcccattgtggcccctaaaatcatagctggtttcccaattaacggtcgttcaacacgcgatagccaatcaatcgcattttccaagacacctggaacactatggttatattccggtgtcacaaaaatgacgccatccgcgtccatgaccgtctgcttaaaggcttgcacctccgcgggggcttctagctcgatatcctgatcataaaaagtcaacgcgcccaagttaggaatcgtgacatccagttgatcggcataccgtttctaaacaaacgttgctaacttacgattatatgaggaacgtcgaatgctaccgacgagtgcgataatcttcatcgtgtgaaaaactcctttaagttgtaattacttttagtataccccttttttggcaaatagtcggaaccggttacaaaaaaccagctgctttcatcaaaattttaatcttaactgctgaatattcagtcagtttagcaattccagtccccatccgcgtaactgccattatcttaagtctaattttaaacgaggtgagacattcattagcgggcctgattattgcttgctcatcgaaataactaccagacataataatcgaggcagtgctttatcgccatcacaggattaataaactttcacaaatgtttcttaacttttttcaaaaccaaacgtccattgttagtgtgatgaatagagtctgctatactattgattagagaaattgattggggggttaatcgtgtattatcgtggtgaagcacttgactttttgaatatgctacatactacaggtgccgcgccattaatgcgttcgcgaatcgttttttccagtcagatcgacgtggaacgcttaaaggctgccgtgctcgcttccgcacaaatcgtacccgagattttcggtcattatcaagctgaccgtaatcgtttcgttgttactgatcaaccagtcaaccaagttattcaggaagttcaaagcccgtatagtcctgaaaacactgattttgattttacgaatagtccgcaactacggttatttgtcattcatcacggtgactacgatgtcttacaagcctttatgagccacctactaacggacaatcgtgggtttaaagaatatctgtacctgctcgcacaagcctacaattatgccgatctcacgaatttgcataatgaacggcgactacgcccagttatcactaagttgcaacgtcaatttgcacggccacacggtcatgcacccattgttaccggtatggttaaactaccccattatccgggaattaacttgcggcacggtggtcacgtaatgctcagtagcacgcaattcatgcgcgtccgacgaatggctaaggcccaagacgtcggtattagcgaggccattttggcggcatacgctaaagcactccaagttttaactggtcatacaaccgtgacattgccgtgcccaatcgacctgcgccgcttcacgactgaagatgcgaacgtcacccaaatcgctaatttaaccgtcaatgtttttctgacaatcaaggtagatattgatgcaccttttagtgagctcgtcaatcaagtccacgacttgttaacggtcgagcgtacgcgggtcgccttcctttatcgacttagcaatttacagaaaatgaaccatacaatgccaatcacggtcatgcgtaaaatgaccaaacgctggttaccacagcctgcgctccggtataccaactttggtgtcgtcgaccaggaacggcttaaatttcatgacttgacggtcgtcaattgcgtcttctcgggtgccttccagtgctcacccgttatggaaattgccgccagcacgtttgccggaacctgtacattgagcttcaatagcaccgggtccgaacgtgactaccagttatccatgaaaatcctggaaaacattcaagctcaactgctagtatgggcacaagcagatgctcaagtagccacaactgataatgtgacgttgcgccaccaagcataattaagtcaattgataggccttaaataccggccacaaaaaatcccaagctaaatgagcttgggattttttatggccgccgttaatctggctatcagtgtgattatggattatttagaatcatccagctaatgacgactagtcatccggccgaatcgtttccgagtaatgacttaactggtatatcggtgcccgtcgtgccaatattgctggtgctttgtgaattttcactaggcaaccagtttgcccacttggggtcagtcgaacatcataattttgaaaactagggcgtattggcgtagtcactgtcagtggtccagtaacgcgctgtaagccaatctgaatatttgctaggtgttggaaagggctcccaactaaattacttaaaaagccatcatataggcgccatagtgccccggcggacggcacccagactggttgtccagcggatgcttgtaattggaatcgtaacgtcacgcactgccgggtcacggtcaactgaatcggtcgaaccttcaaccgagtagtagcggcttttaggactgcaacttgggccaacgcttggggaacatcatagctcgccgcaaatactgggaactgattagtgggtacctgtcgtcctttttccgtagtcgtaagttgccggataactttcatcattgcttcaaggccaagtacatatgcgcgttcgtattggacccgctcaaccggtaatgctggtacaattaattgtgtcattttgccacccccatcaacacgcacttaattatcgttagtttactcacgtcttcagccccagtaaagccttttcagctatttcgttaattaattttgtcaaaagttttatctagtaatgtttctaaattggaatccttctaaaaagtgtggtttaataagggtgaatatgataaaaggaggaaccgcgtcgtggcagaagatatgttgacccaagccttgcagcaattaaaggaccataaaatccgtgtaacgccgcaacggcaaatcattcttaattatttgattactcaccataatcatccatccgtcgaaaccatctatcaggaattagcaactcaattacctaacctgagcttggcaacggtttacaatacgttaaaactttttatcgacttaggaatcgtaattgaattacaaaatggcgatgctggcacccactatgactttttcggtcgaccacattatcacgtcgtttgtgagaattgtggtaaaattactgacgttttcgaacccgacctccgcagtgtcgaagccaaggcggcggaactctctgggtacttggttacgggtcacaatatggaagtctatggattatgcccagactgccagaaactactcaatgtaactaaaacagctgatttaaagcgattgaaattgacgcacagtgaatagaaccagttcaatggcaaccggctatttagcgcgctggttatcctaaaacaaaaggaacactttcagttttcctgtattagtccctgtcaaccttaagtggactatcacagcctgaggtgttccttttaatttatacgataagctggtcttacttacgctttaatcagcatcacaatcggaggacgctttcggaataccaatcagcaattacacgaccggtagccctcaaccccctggccggtattaatgttgtgggacttcttccagcatgccatagaactgtgacttgtcagagaaatcagccatataggccccgttcaatccggccttttgcccgattattcctaagtcgatcattagcttttcttcttcatctggaaagtgtaaccgtcccttaatggctacactacgaatatagtttactaggcgattgactaaggcttctgggttcttagtcgtagtaatttttttatcgacctgcattaatacatcaataatatccaataagtcccccgactgatcagaccacccacttaaccggacgattagtcccttaatagcctcttgagcttgttgtcgtaattctgattctcgctgcattaataaagtccccctctatatgattcggattaccataataatttcaaattataggtatctttatatacacttttattatacacgcttatgattgcattcaaaaaaccattcataaacgttcaaaaaacgcccatcaacgtaaaaaagtccgagctttcacccgaacttaaccccactttaatttactaattaccctaacgttcctgtccaaacgcaaaatagagccacggtccaaatggttgtacaaaggctaataacaaccagccaagtcgatgtcctcggcgaaatgacttcgccgtcaagacatccgcaaccacaattgtggttgcggtaatctccatggcggcaacgggtaacaaccgttgctttaatttacgtttgatccgtggtggcatttgattgtgatgacgaaatagtcccatattgacgcctcccttaattattaccaacattataccttgttaattaagaaagcgctatcttgattcatacccttgtggggctcgcccgacaaacttagtgtctgggatcgtcaattcatcaataaccgctttcccatgcagtaactggcgcgttgtcacaccgacctgtcctcgatcgattgtaatgatttggtaactactgccctcatgaacataatgatgatgtggatcatggcaatcgatcgcataggccgcagaaccggccaccacattcagaatattatctccaatcaaataacttgaaacaaagtgaacgtgaccagagaatacgccgcctaaattatgtccccgaagcaccgataacagcgccggcgtattttgtaaaatcgcatagtgcatatttgtcatcgtcggcccatctagggggtgatgcaaaaatagaaaagcccgctttgtcggtgcctgtcgtagatgttttcccaaccattgtagctgttatggtgccaaccagcctgcctcataaccgctaacctttgaatccaaaaaataaaagtcgttgttgccaatccgcatgcgactcgcgtagtatggtcccgggtcagccggcaaatacccctcgtaaaacgccgctcgccgatcatggtttccaaggataactcgaacatgacaatcaaattcagcttccatcgtatggatgattgcgtgcagccgctgataatcgtcagcgctaccgtcatgaatcaagtccccggtaaaaacaatcaaatctggcatggttggtaatcgccgaatatcatcaataatattggcaagcttgccccagggatcgtactgctgaccatgtgccggtacttggccgcggggggttaaatgtagatcagaaatctgaataacttgtaaaggacgcaattcgatcctccctctcatactttaatcaccagatggttatctctaatatagcgagctaacgtaaagttttaccaatcttcatataaagtaactgtaaagtttgtgctaacctctctttacgcaccattgaaaggtgcccccacagcaacacctttcaccaatagttcagccatcacccgtattgccctcattatactgaaaccacattatcggcagcacgtgcccaatggttttactgtaagtcttcagtatatccgcatcttatttcaccgtcccccaaagctagttgttcttgacatcagcacttggcacatgccacccgtgtttcatactgagctagctagtctgacgcgtaatctcataatttttggttgacaagcccaccttttgccgccaccatgaagataagctttaataacatcatacgagtgagggattattttgaaaaatatgtttgtcgggccccatgtggcccttgctgttccccagccagaagattttgatgagatcagtgactggtacactgacgccgattttgttcgtaaaatggatacggctgccgcccgaccactgaccggtgaagaactcgaacgaacttaccgtaaccttgatcggaataccgaatactactttcacgttcatagtttagaagacgaccacttattaggctttgtcaccctattcaatatcgaatggcataaccaggttgcccaattagccatcgcaatcggtgatcccgacgaacgcggccatggttatggtaccgagacactcagcttgattttgaactacgcttttaacgaattgaatctttacaaagtctgtttggacgtcatcgcaacaaaccccgccgctatcgctgtttaccagaatagtggttttgaatttgagggcaccaataagcgtgctatcaagcgtgatgggcaacgaatcgacctctatcacatgggcttatttgcagctgatttccagccccgcgttactttaaactaattaatcagctcaattagttgcagccaataacttttgcaattataatagtcgcagattgatagaaagtgaccaactgactgtcaatccttaatattctttagttttttcgattattagtgcgttgctgccataatgcagctaataatcactttcattcatagactcccccaagtctgatgaatggggttcatcaaagcccccactttgatgtttcctactccttgaccactacatccgttgatgtggtggcttttttattgccgtctaaaaaagccgtcatgggtatgcaatccccacaacggcctgctattatcttgtaatagccaaaacaagcggttcaacaactgcctgtttcgattagatccaactggtacccaatctactcacgagtaaattatgtgccaccaagatttaatcttcttccaactcaacattgctgttcgttcgacgagcaatgaaccattccttgacttgaattaaaacccacgcgattcccgctgtaaaaagcaacaacattagtgtcgaaacaataatgacgatcacaatctgaacgccttctgcctttaacacgtctaacttagttactaacgcgatccctgatggaatgaaaatcaagctgataaattggacgaaaaagttgctaacacccgccacctgctcaagtttgaccactttaaacgttaacagcaagtatagtagaatcatcccaatcaacggtgtcggcattgggaatgcgggccaaatcttattgactaaattagcaattaaactactagccaataaaatcaaaccataaatcacaatttgtgtaataaacgcgccttttttcatcgaatccctcccggaccatctaacctaaaccaatcaactgcgcaaaccctggaaccataaaattaacaagaataccggcaatcacaaaggcgattgcaccagttgcgcccgcagcctcgctcacttcaatcgctttagtggcaccaaccgcattaccggcaattccgaatcctaacccggcaccgagcggattcttgtgcaatttgaaccagcgaataaaatggtcgcctaacgcgtaaatcaaaactgaattcagaatgactgcgaacgccgcaatggcttgatcgccacccaccgactcagccaccggtaaagcaattgctgtcgttgctgcttgtactaacatggcacctaacgctgcatccgtcagaccgagcaaccgtgaaatcccatagataccaaataatgacagccctaacccaatcgctaacgcaatcacaatgacatcccaatgtttcttaaagatatcattacgcttatatagtggcaccgcaaacgagacggtggcgggcgccacaaaccagaataaccagtcgccaccaacctggtacgcttcataaactttttgcacgggtgcctttagaatcgacgcaatcaataccaataaaccaatcccaagcagcattccaaaaaataacggttggaataacacaaagcgatttgttttgtgatataaatactcgccaatcccatacaccaagatcgacagtccgatcccgaaaaacggattattgagaagatagctcacataagttcctactttcttttagtgaaaagagtgacaaaaaaggtgccccatccgggtctagtcatcattaaatggtggttaggctcagaacagtgcaccaacacggttctcatttatcattaattaattataacacatcaaagtaatttttaatagtaggttagttcgtcaaatttaatcaactgtataaaacatcaacgcgtaagcgccaacaccggtgtgcgtcgcaataattggactagtgcgcgcaaccagtggcgttacttgtggaacgacttgttggagaagcttttctggcgcttccgcaacgctcggttcgccgacgtaagaaattccagccgcttcgactcgagttgcatccgctaattggtctagaatttgttcctgcgctttgattagcgcctttttcccgcgaccccgcgtataaagttttaattttccggcttctaattcaaagacaaattttaatttaatcaaattcgtgaccatgccagccaacttagggacgcgcccacctttgaccaaattgtcgagcgtatccacgaacaagtaggtcttagtatgctgccgaatgacggttatcttcgccaaaattgtggccatatccgcaccggcgtgagccattcgtgctgctgtaagcacttgaaaggccatcccacggtcagccgcctgggtatcaataactgtcacatcgccactagcaagtttggcagcttggcgagcagcattgaccgtcccactcaatgtctccgtcaaatgtagtgataatacttggctaccatccgctgtcaattcatcgtagcaactgacgaaatcaccaattggcggctggctagtcgttggcaagactgggctgactgccatctgttggtcaaattccgcggtactaactgccgtatctgcagtcaagtcgccaccgaaccccacgagtaacggaaccactttaatattatactgtgcaatctcggccgtcgttaattggaccgacgaatcggtgacgattttaattgtcatatttggaaaacacctttcgattaatttgtgcttcattatagcacctcagagtctaggaccaataaaaactgcgtcacaccagcatttagccactcatattgatttatgacggtcatcatttcgttataaactttgtaaaaatcgtcatattttttcgttccatgacctaactttttcgtctgaaaatcatgcttttaaacttttcgcgtcacactttcttcacgcgtcgccgctatactatgtttatagtcattaaggaaatcccaatccttaacgaccccctaactttaatgattacttccccaagtaatgatgtgtgtgtacttaattacattttaccgatttacttcccttttcctccgtatttccccgatacggaggttttttattgccttcaagcagttgtggctcacgcgtgaacaccgtattaaccataatcattgccaatccaatttccaccataaaaaacgcgccaaggcgagaaacaaacttctcaaccttaccgcgtatcgtggtcctaatacttatttcatcttatcgagatcttctggtgcaataaaaaaactgacctgtcccgtttctaaatcaacgtgcgccttcacttcaacacctttaggaaaaatccagcctttcccagtatctaactttaacggcatttccccatacgttttggttcgatacgtcttttccatcagaaaactccttcgctctttgccaattacgattaactgggctaattatataatctgacgtcgtttctcgatagtaaagacactttccaatggctttcttcagtaggaatgtcacgctaaatctgatagaatcggattaacattaaaccacttaggaggagtcgaccttgttctattcgttttttgatccgacttacctattagtcatcattggactgatcatctcaatggccgcatcgggttacgttaatcggacattccggcattatgatgcctatcgtagtcaatctggcacaaccggcaccgatgcagctcgctttattttaagccaatctggtatcaatgatgttggtgtccaaaagataagcggggatctgaccgacaattacaacggtcaaactaagattctcagcctatcagaagccacagcagattcaacctctgtggccgccatcggagttgcggcccacgaatgcggacacgcagttcaagatcacgttaactattggccaatgcgcttgcggaccgccctcgtgcccatcacgaacatcggttcaagcttatcattaccactaatcattatcggcgttttattgagttacaaccaaacactgattcacattgggattttactcttctcactggcgttattgttccaacttgtcacacttccagttgaattcaacgcctcaagacgcgccctccagattttatctgatgagcaagttttgactcgcgacgaagttcccatggtgcgtaaagtgcttgtcgcggcggctttaacctatgttgctgcagccctgtcaacattcttacaattactacgactaattattctatttggtggtaatcgtgacgataactaatcgtgccaaatggcagtgcccacagccagtcaccaaaatctgcttggtcactatcaacttagcgtcgccgcaaacttgttattactagcattgattgcgaatcaaaatagtcacttcaaaggacaacttttgaagtgactattttctttggccccaaacagccgatcatcgcacctcgccaaggcattccgtaagaacgttgatgattcttcacacttcttaataaagcctttccctttttttcatgacattcgccatgttcagtcacaaattcttcacacaacctcggtatgattacatcatagcaattgaggttaactcaatcagctataacacaacctaaaatttttcatttactcctccaaagtaatgaaattcatagtaacatgtgattccccgtcacatgtttaccctactcctttttccaccgtattccccgatacggtggtttttttgtttttctcgtccgctctattcgcacctaccgactactttaatacgtcatagtaatcatatttgttgtactttttacattattaaaccaaaatataactaatgattaaccatgctttttagttattcatctgttaagggggagatttactgatgaagcaagtatcgattattggcgctggtattggtggcttaaccgctgcagtacggcttcaaaaattaggttataatgttacgatttatgagcaaaacgcgcaaccgggtggcaaaatgaaccagattgttagccaaggatttacatttgacgtggggccgacgatcgtcatgatgaaagacatctacgaagaagtctttcgcttttgcggggtcgatccgcacaactatttaccattcgaagaagttcaacctttgatgcaccttgtctttggtgatcaatctagtctagatttgtcacgcgatctcccaacattaattgccgagattaaccgcattgcgcctgatgacgtcaatggtatgttaaattttttagcggatatttatcaccggtataccatcgcgaagcctaattttttagaacgatcatttcgtaactggcgtgacttttataacctacccgctctgtatgcaggactacagttacgcacctttaacaatgcctacaaaaacattgcaaaatttatcaagaatgaaaatctacgtaattcattagcctttcagacactgtatattgggatttctccctaccagggcccgtcgctatacaacattattccgatgattgagctcttctacggggtctattttttaaagggtggtatgtacacagttgtcaatagtctcgttaagttattcaaagaacagggtggtacgttaaagcttgccacaccagttcaagaaattatcatcaaagataaagttgctgttggcattcgtgtcaataatcatccgatccacagtgactatgtcctatgtaatgctgattttccaaccgccatgacgacactgattccaaatgagcaaaatcgtggtcagtacacagatcaaaaaattgccaaaatggattattcatgctcatgtctcgtcttgtatttaggactagacaaaaaatacccaaccgaagcattacacacgatccactttgcacaagatttcagcaaaaacgtcgccgatctatttgacaacggcaagttaccagaagatccctcgtattatgtctatgttccatcaaagatggatccaagtttagctcccgaaaacagtgaggcactctatgttttagtaccagttcctgagctctcaaagtttaatgactggtcaccaacaacattgaagaactatcgtcaactaatcattaacaaactaagacaaacggctaccttcagcgatattgaacagcatatcgttgtcgaaaagcagtttacaccggttgacttcaaagaacagtttggcgcctataacggagccactttcggcttacgaccgacgttaaaacaaagtaattattatcgtccccataacaagttcgactatgccgaccatctttatttttgtggtagtagcacccaccctggggccggtgttcccattgttatgcaaagtgctaaattagccgttgaggagttgattaaagatcgcgcgttttataatcaagtnnnnnnnnnnaatttgttcttgcaatttggggttgattaaagatgaccaaactaatgcctaaattcgaacaacatcgtactgactttgcgtactgtcaagcaattactaaaaggtcctctagcgcattctacaccgccttctcgcaattaccactagaacgcgcttggagtatttacgccgtttatgctttttgtcgaacagccgacgacctcgttgatgttgaccatgatattgatggtctaatggcattacgccaatcattgaccgcctttgccaatggtcatgtcccagaccacccaatgtggcgcgcactggccgttgtttttgagacttatgatatgaatcttgacgtctttttcgatatgctcactggtcaagaacaagacgcgacttttaaacaacctcaaactcagcaagcacttgaagactattgctattacgtcgccggatcagttggtctgatgattttgccaatgctagcaactaacccgcaatcacttgtcaaaccagccgtagaattaggcatcgccatgcaactcaccaatattttaagagatgttggtgaagactaccaacgtggccgaatctacctgccatcaaaactattggcacactatcagctcaatccaactgacttgcatggccccatcccatctgccaattttattcggctttgggaacatgaagcacagattgccatgaacaagtacgaggctgcattaaccatgatgccacaaattgatcccgtcgcccggccatcgctattagccgccactttgctttatcgtgaattattgctaatcgcacgtgaacaacactacccaattttaagtcagcgcatctttttgacagatgaacgtaaaacacaggtccttaatcaagttagcactaaagtgcatgaactagcccttaaggaggcttaatgcgacttgaatcggtatcatacttggcacgacgaaatctgtccataccggaatatcgaccacccacaaataatttttagttttttcaccagtcaagtaagcgatttagttaccttttaacaatcaaactactatactaaacatatagtgactggacatctccttcagccacttgaacctttttcatttactcctccaaagttaatgaaaaacaggctcgctggggatgccacctagcgaccaatgcaatttataggtcatcgcccgccgcgatggccttttatattactagaataatatagttacatctcacttctaatcggcgtatcatattattgagagattagaggagtgatatttaatgaaaaaaacacgcgccgtagccggaattagtgctcctgtggcaattttttcggccgccctattcgcgagtgagaagctctacgattttgctttcaagcgtgttgattacgtgcccgaaacttcggcagataaacaaaaatacgccgatgcctactacgcttatgtcgattggctacaccgacagcccgttcaacagtggcaactgaacgctaatgacgaggccaatcaccttgtcgcacagtacgttcctgctaaaacaaccagcaaccgaaccgttattgtttcccatggctacaaaggtgatggtgaaacgatggcaaattacgcttatggtagattgtaaaattannnnnnnnnntaaatttgcaatctaccttatatgttccatcaaatgggctataacgtcctcttgcccgacgatcgcggccatgggcaaagtgccggcaagtacattagctttgggtggcaggatcgccgcgactatttaggctggatcgataaagtcgtccgtatcaatggtcgtcacacggatatcatcctttttggtgtcagcatgggtggtgcgaccgttgaaatgatgagcggcgaagaccttccatcacaagttaaggccatcattgccgattgtggttattcgagtatcgaggaagaactcgcttacttattaaagcgacagtttcacttaccaaagtatccgtttgtgcccatcgttagttttattaaccgccaccgtatgggctattatttaagcgacgtcagttctgtcgaacagctcaaacataaccatctaccgatcttctttattcacggtgataaggatgtctacgtcccaagttggatgctcaaagaaaattatcaggccgctaagggccccaagcagatgtggcaggttcccaacgccactcacgccgagagtttttggatcgatcctgccgagtatcaacgacatgttacagcctttttaaatcactatgttcctgataaataaaattcagtcgaaaaaccgtatgcgctattcactacgcatacggtttttttgaccgcttaagttgttttatgactggctaatgattcgggctaagcggtccgccatccgttccagattggctggtccctgcgccatggcttgatctaaggtcatgacttgatcgacaatcggtaaaacggccgtgaccccctgtttggcaaatgtttcatttgcacctttctgccgaccaactaataaatagcaaggcttgccggccgcttgggctaactgactgagctgaattggtaccttgcccataaaactctgatcgtcgacttggccttcaccagagataactagattcgcttgggccactttcgttttaagattgctcatttcagctaacaattgaaaaccagagcaaacgcgggcgtgtaaaaagtaacgtaatgcaaacccaataccaccggcagccccatcgccttcgtgggcactcaccgcaccagctgcgaccgtcatatagtgagctaaagcggcatcgtgaacctgaatttgagcaaccggtaatcctttttgtgggccaaaaatcttagctgcgccgttcggtcccgttagtggattcgtcacgtccgctgcactaatgaacgagacttcagctaattgtggcaacacatgtcgatcgtcaatcttagtgacccgacttaaatcagcgccagtcatggctaactcttgaccatcggcagcccaaaaacgataaccgagcgcacgtaggattccggcaccaccgtcgaccgttccgctaccgcctaagcccagaataatctgccgagcgccacgctcaatcgcatctttaatcagtagcccggtcccataggtattcgttgctaacggcgtcaaggtcgtcgtgacaaactggattccggatgcagccgcaatctcaatcactgccattttttcagtggcaaagtagccatacgttgcagtcactggccgttgcgccagatccaccgttgatgccgtaatagcttgtccaccagcatggttagccagccacgccgccaccgttccttcaccaccatcggcaatcgcaacttgagtagcggtgattccgtgagccgcaaatcgtttagccactattcggttggcctgaatgctcgtgatggaatttttaaatgaatcaattgcgatcaaagcgtgcatattaacgtctccctattgacataattactttcagtataatcattacagcgggcgcgagcaattcatatcagttgtcaggtttcttaaaactcgttaagcttaagttaccaaaattttaatggaggctgataaatcatgacaaacaaatacgattacgatgtgttatacattggtgcgggtcacgccacgtttgatggcgccgcaccactcgccaagactggtgttcgcgtcggtgtgattgagagtggtctgattgggggcacctgccctaatcgtggttgtaacgccaaaatcactcttgatgaacctgtcaaattaacgcgggaaacagcacgcctcaatgatattttgagcagtgcaccaaccattaattggacggccaacgtggcccataaacaagagattattgatcccttaccagcaggcctgacagctcgtttggaagatggtggtgcaacgatcattcatggtcatgccacgttcaaggacgctcacaccgttgtcgttgatgatcagcaaaccattaccgctgaaaaaatcgttattgcgactggtttaaagccccatcgtttagatattccggggaccaagctcgcccacgatagtagtgattttatgaaccttaaacggttaccacaaagtatcgtcatcattggcgcaggctatattggtatggaatttgccaccatcgctaacgcagccggtgcccaagtgacagtcatgttacatggcgaccaggccctccgtgatttttaccaaccattcgttgcacaagtggttgacgacttaaccgaacgtggggtgaccttcatcaaaaatgccaacgtgcaagcatttaccaaacaggatgaccagttccaagttagttatggcgaccaccagcaattaacgaccgactggatcctagatgcgactggtcgaattccaaacttagatggcttaggcttagaccggattggcgtcaaatatgaccgccacggcgtttatgtcaacgaccacttacaaaccaacgttcctaacatctatgcagccggtgatgtccttgccaatgacttgccaaaggtcacacctgcagcctactttgagtccaaatacttgatgcgtttgttctctggtcaaaccagtgctcccattgactatccggtaattccatcggtcgtctttacttcaccacgaattgcgcaagctggcatgaaaataccggccgctgaaaaggccggcttaaccgttagtgataacgatttagcagattactggtattatcaagtctccaaggaaccgattgccgctagcaaacaggtccatgaccaagacggccatctcgttggcgtgactgaaatcagtgatcaagctgaagatgccgtcaacgcactactgccagctatcgaatatcaattagaccgcgaacaaatcgaccgtttgattggtattttcccaaccatcggctacgcagcttggcaccgggcttaaaacagaaaacactgctgcgaccgccgcttgattaatcccttattaataaccagagccgccaatgacccccactcattggcggctctggttatgttcgttccattactttagaaaccaactcgggcctgcacatcaagcatactgaccatgctataattgcgcctatctcaacgattgaaaggttggtcctaacaatggatgtggatgctcaaaaattatttaccttagtagatgctgcttataatcagccgattaccaatcaaccatccgattcctaccgccaagcgctactggcagctgcaatcgacctgaataacaacgtttcgccacagcaagtaaccattcagctatatcaagcctattatcgtaactatatggtcccaatgactctaccacgccggcatcgtgacctctaccaatacgttcacacccaattacagcgcctcacgcgcaaagaacagcgtcatatggcacttgggtatggtctgattgcgacgcacctaacatttggtcccttgaactgaaattaagttacttacacgcattgcgctagttattgtttagtatgaagcatgattaaaccgtgccattatcaagctcaaaaatagccattaatcgtccccagccccggaggtcgaaataggacgcgcatcggctgacgaataaacagcccatctttttagcacgttttaatcataataaaagccccagcgattactcatcgctggggcttcatcgtttttaaattaatcgtctaatcccaatcgtttgaaaatatcatcaacgtggcgaagatggtaatgatagtcaaacgcatcatcaatcgcagcctggtccaaatgttcacgaatctcggcgttaccttcaataagtggcttgaattgtaactgttcatcccatgacttagccgtcagtggttgaacgaggtcataagcactttcacgagacatccccgtatcaatcaacttgagcaagacacgttgactgtagatcaacccgtaagtcgcatccatgttttgcttcatccgttctgggaacaccgtcagcgtcttaataatcttattgattcgagttaagatataatccactaaaatcgtggtatctggtaagatgatccgctccgcagaagagtgggaaatatcccgttcatgccacaacggcacatcttcataggcggtcatcatgtggccgcgaataacccgtgccaaccccgtcacgttctcagaaccgatgggattacgcttgtggggcattgctgatgagcctttctgacctttattaaagaattcttcaacttcatgagtttcagatttttgcaaaccacgaatttcggttgcaaacacttcaacgcttgttgcaatcaaggccaaactagcaatgtattcggcatgtaagtcccgtggtaaaacttgcgtcgaaatttcttgtgcgcgcaatccaagttgtttgcagacaaattcttcaacaaatggtggaatgttcgcaaaagtcccaacggctccactgattttacccgcttcaacgcccgcggccgcgtgttcaaaacgctcgatatcccgattaatttcagaataccaccgggcaatcttcaatccaaacgtggttggttcagcgtggacgccgtgtgtccgccccatttcaaccgtatatttatattttttcgcttgttgtgctagtgtcgcccgtaaatcttgtaagtcttggcgaataatcgcgttagcctgcttcaaccggtaaccttgcgccgtgtcgacaacgtcagtactggtcagcccatagtgaacccacttacgttctgcacccaacgactcggaaacatcgcgcgtaaaagcaaccacatcatgatgcgttacggcttcaatctccgcgatccggtcaacatcaaacttggcattctctcgaattttagcaacatcacttgctggaatcttccctaattcagcccaggcctcgtcggcagcaatctctacctccaaccatgcttggtactgattttctaacgaccatactttgcccatcgcgggacgcgtataacgatcaatcattgctaatcctcatttctttttaggtattcactaacaaaacacgaacattattatagcatacccctcgagtaattaatagagacgaacaatgaaaaaatactgttatttttcactttgtttccatattaaggacttgttttcgaactaattcaccttaattatgaacgattatttgcgctcgaaacaagaacattcggtttttgggttgcgttttgacgttaaagttgctatactctttcctgttggagtggtgaacgtttaactactctttaggattaattattcataattaaactatttaatgaggtggaagaatatggcatcagtcgtagtagtaggtagccagtggggcgatgaaggtaaaggaaagatcacggactttttgagtcaggaagcagatgtggtatcacgttaccaaggcggcgataacgccggccacaccatcgtatttaatgggcaaactttcaaattacggctgattccatcagggattttcttccatgataagttagctgtcattgggaacggcgtggtcttaaatcccaagtcattagttgaagaattacaatacttgcgggacaagggcgttaatcctgacaaccttagaatctctaaccgtgcacacgtcatcttgccttaccacatcacattagatggcgctcaagaaaaagctaaagccggtggcaagattgggacgactaataagggaatcggcccagcctacatggataaggctgaacgaattgggattcgcgtagccgacctgcttgataaggacacctttgcggcgttactcaagcgcaacttagctgaaaagaaccaaattattaccaagctttatgacttagaaccactgaaatttgaagatatttttgatgactattacgcttatggtcaaactttgaaaccattcgtcaccgatacttccgttgtcattaatgatgcgttagataacggtcaacgcgtcctatttgaaggtgctcagggagtcatgctggatattgaccaagggacttacccttacgttacttcatctaacccagttgccggtggtgttactattgggagcggtgttggcccatctaaaatcgataactgtgttggggtcttaaaagcttacacttcccgcgtcggtgacggcccattcccaactgaactctttgacgaagtcggtgatttcattcgtgaaacggcccatgaatatgggaccgttactaaacgtcctcggcggattggttggttcgatagcgttgtattacggcatgctaaacgagtttctgggtttactcatcttagtttgaactgcttagacgtcttgacgggcttaaagaccatcaaggtatgtaccgcttatgacttaaacggcgaaaccatctatcactaccctgctagtctgaaggaattagaagcttgcaaacctatctatgaagaacttcctggctgggacgaagacattactggcgttaaaacctttgaggaactgccaactaatgcacagaactacttgcgtaaattagaagaactcgtcggcgttaaaattgccaccttctctgttggtcccgatcgcgaacaaactaacgttatcgatcacaacatttggggctaattgaacgcgacaccgtgaattaacttaaaggagttttgcatcatgggcatggagatttttgattacgaagatattcaactaattccgaacaagtgtgtcattaatagtcgttcggaagccgatacgaccgtagaattgggtggccgtcgttttaagattccagtggtgcctgccaatatggcaaccgtcatcaacgacgagattgccaagtggctcgccactaacgactacttctacattatgcaccgcttcgcccccgagacccgccgtgcttttattgaaacgatgcatgccgcgcaactgtacgcatctatttcggtcggtgttaagtccagcgagtatgactttatcgacgacctggctgctaatcaaatcgtgccagaatatatcacgattgatatcgcacatggtcatgctgacagtgtcattgcaatgatcaagcacatcaaagacgtccttccggatagtttcgtaattgccggaaatgtggccacaccagctgccgttcgcgaccttgaaaatgctggtgccgatgcaactaaggttggcgttggcccgggtaaggcctgcattactaaagtcaaaacgggctttggtactggcggctggcaattagctgctgtccggtggtgtgctaaggccgctcgcaaaccaatcatcgcagacggtggtgtccggaccaatggtgacatcgccaagtcgattcggttcggcgctacgatggtcatgattggctcaatgttggccggacatcaagaatcacccggcaacattttaaaaatcgatggtaagacttataaacaatactacggttccgccagtgaaactcaaaaaggcgaacataaaaacgttgagggtaaacaaatgctggttccttaccggggccgcttagttgacaccttaaacgagatgcaagaagacttacaatcatccatctcatatgccggcggccgggatttaaaggccattactaagtgcgactatgtggtagttaaaaattcgatttacaacggggactaattaagactcactaatacctaaaaagcttgtcagccatttctggtctgacaaacttttttagtatccaattctaatttttacactcactttaccctgacagcggctatgaaagcggttataataaagctaaatcactaatcgaggtaatcagactatggaacacaatcgggtcttacgactagaacacggtattaacttccgcgaactggggggttatgagaacaccgctggtcagacaatcaagtggcaaaagctgctgcgttgcggtggcatgtcactactcactaaccgcgatctcacctacttggataactacggactccgttatgatatcgatttgcgccaagccaatgaagctgagatgtctccagaccgttatcccaagaatactaagtatattaatacgtctgtctatccgttcactgacaatcgtcgctttgatcgccgtttaaaacggctcatcaagcgaatggtcgtcgatgattccttcaacgcacaaacatacgcgcaaatgattacagatagtcatgccgtgaaagtctggcaaaatttatttgcgagcctcctcgccaacgaccagcccgaccaatcggtactctttcactgtgctgctggtaaagaccgaacgggggtcgcgggtgcgctcattatgacggccctagacgtcccccgtgaaacgattatgcaggactacctgctcactaacgccatcttcatggccgcagacagtatggataccgctacgatcattaccaaggccaatgctggtgacctagctagccaattcaacgttgccatggctgttgaagccgacaatatgaagatggtctttcgggttttcgacgacctctacggcaatggtattggttatttacgagaagtgcttgggttatccgtagcggatattaataatttgcgccaattgtacttgaacgactaagaaacactaaaaaaactgattttgaaagtcaataactttccaaaatcagtttttttgcatcatctattcaattgtttaattataaaattggtgataacaaccgtgaaaatgtctgcttgaacttcaaccagaatgattggtttttaaagtcttgaacggtaatcaaactactgattttttgatcttctaagaaaatccgttccaattcttgtgctaaatcagcatcgtataaaaaggcgttcacttcgaagttcaacttaaaactccgaaaatccaagttagcggaaccaaccgaagccacctgaccatcaatcacgatggtcttggcatgaataaaaccattattataataatagatttttacaccagcatctgccagctcccgggcatagtactgagttgcccggtaaacaaaggcatgatcaggtttgtccggcaccataatgcggacgtcaacccctgacatcgcagcgattttaatcgcatctaatacggaatcgtccggaattaggtatggcgactgaatccataaacggtgttgagctgtcataatcattttaatataacccaatttaatctgttgtgcatcactgtccggaccactggagacgatctgtaatgaagtattccctttaacgcgaatgactgggaacatattaacgtctggcacgattcgatgttccgcatcggtggcgttccaatcacgaatgaaacgttcctgcaattcaaaaactcctgaaccgacgatccgcaaatgggtatcacgccagtaaccaaacttcttactacgaccaaggtactggtcaccaacgttaaaaccaccgacgtagccgacccggccatccgttaccacgatcttacggtgatcacggaagttgagacggaagtccaaaatcgctgaatgagcacccaagaacggtcgggcatgcccaccaagttcttctaaatgcttaaagaagctgcggaacgtgcccatcgacccccacggatcgtacaagacacgaacgtcgacgccttgggctgctttccgctctaaaaggtgtaataattcatttccaatctggtcattataaaatgtgtaatattcaatatgaatatgattcttagctgcttcaatatcttggaacatcgcatggaacttctcatgtccatccgtataaatcttgacccggtttttacggcttagtaacgcgccatcggaattcaagaataaactgaccatcccacgaaccgagctagtgaccgcatctgcgggcatcaattccgttcccagggcttcacgttgccgctgaatcatctgttcgagtctaatttgcgtctctttacgtaaccggaataaccggtttttcggtaacttacgaccgacaaaggcgtacgcgataaacccaataatcggcaaccaaatcaacacgagtagccaagcccaagtggccgcgatgtcccgattacgatcccggaacacggtaacgaacgccgcggccgcgtttaaaacgataattgtatagaaaattggctgaatatattgcaatggaggcacccacctaatttattaatgatggttttattttaccgcagatagtagtgagataataatcttttgcgaatataatttttgcatttaatcattaaatagctaataattatgcttaaggagggcgcgttcaatgcttgcaatgcttggaattcacggcctcggccccattcgcatgtttcacttaaccgaacacattgcgggtccgcgagcggccgttggtattttactaattattattttattagcggtcgtctaccgttactatcgacgacatcgttaataaatcaaatctttgaagcagctggtgaagtctcccagctgtttttttgtgggtcattatcttacggatcggtttattcaatcattgcagtatacctctgctaccaccggagaaactcataacaaatatttttgaccaagttaaatcctcaaataaaaaagttgcgttgattagacaatcaacacaactcgattcgaccaccccttctgaacatctgttgtatggcctgattgagttaacgcattacctaccccatttttcaatgtaggccgatagtaaactaaatcattggaaccacctggttaatggctttttatgaaatcgttagttcacacaaagacttgtcgcttaaagcttggacgtaattcgaacgtcccgttgcgctgagtttttgattggtatcgagatagatttcacccgtccaatgctttatttttttagtcggcggtctaacgattacgcgatagacgatggggcaatttttcagggtcatattttttgatgactgatgcaaaaactttttgtatttcttactttccgctaatgtttggctggttgcaaatgtgtattcataccaaataatgccgctaaaagggccggattcttccttgattattgtgtttctcgagacacgcacgtcataaggactgctttttaacattgttgttagtacagtcctcgcttgatttaactcaatacgatttttaacgtacccgtataaacagaagctactaataaggataattgcaaaaagcacgtaatgtgtaacggtctttgctttaagaaatgacgacatgactaatgcctcccaactttattatctggaaatagtctggcaatgctttatacattatgaatgcagacgtactagtatcaatacttttattaccaacaccaaaccaatcagcttgctatccccttttttgattcaagatctgccagtcattgcaatcactagcttcgataccagcaacaatcagcagacccagtagtccactaatttcaagtggcctttaatattggtcaggccttgatttgcgttctccttttgaatatagcaaacgccaaacccattgtcaccaactaatgaatatcattcgtatttgttaattttagaattgcaatcaagtttgtatttggaataataaaatttatgcaaatgtggtcaataaatgttgatattggaaggtcgagacgaatcacatcagtttcccgtaggccgttttacctgcaagaaaattaattatccaatttgattcatcaaaatactttaaggataatcataatcccattttattcatataatcgatatggcaaattacaagtttaatcnnnnnnnnnngattaattatagaatttgccatatcaataaaaaagggttccaataagccgctcactctctccagttcttcaggttgcatcaatcaagtggcgatttagtgagccaaaaccatatttcctaaggtccttcaataatccccactcacaatcgcaatcacaaggtaagttaaccttcagaaaaacaatccccgccatgttcgctatatcaccctattaataggcgttgaataccatagctaattaatcacgattagtcagacaatcagcaagaagtcgcaggatgtcgcgcgattgcgtccaattatttggcttttagtcactatagcccatcagaatatttattttggtcagattgaccatcgtaactttgtcaaaaccgattaaactaaagctatcacatcgaaatggggcgatgattatggatttatcacacacgcggttactccgcaaaaaagatatcaatgccatgttagccacttatcacagtccgctcaaaaaggaacttaaaacatttgacctaacgatgctgggaattggggccatcatcgggaccgggattttcgttttaactggtacgggggccttgacggctggtcccggcctaatgatctcattcgtcttagctgcaattgcttgcctgtttgcttcactctgctacgctgaattcgctgcgatggtgcctgaaagtgggtcagcgtacacctatgcctacacaaccctcggcgaaattgttgcattcattatcggctgggacttgatgttagaataccttttcgctgtctcaaccgtttcagcgggctggtcaggctactttcaatcattcttggcgggcttcggcctcaaactgcccgctgctttgtcggcagctgcaggttccgtccctggtgtgaccagctattttaatctgccggccttcaccattattatcctgattaccactttattgtctctcggggtcaaagaaactaaacgcgtcaataacgtcatggtagtgattaaattagccgttgttcttttattcatctttaccgcggtgcgcttcatcaaaccggcaaactggagtccgttattaccatttggcttcaaaggggtcttcggcgcagcctctagcgttttcttcgccttcatcggttttgacgccatttcatccagcgttgaagaaacattggaaccatccaaaacactcccacgttccatgttactgtctcttggtatctgtaccattctctacgtggctgtatcagccatcatgactggcgtggtcccatttgaaacgtttgccaagtacattgatcatccgatctcggccgttcttatttactccggtcaaaattggatggccggaatcattgaccttggcgcgattcttggtatgaccactgtaatgttagtctgtctctacggtcaaactcggatttccttctccatgtcgcgggatggattactcccccatgtctttagcgatattagcgccaagaccggtgcaccacttaaatcaaccgtcttgtttgggtcgattgccgcaatcatgggtggctttattccattagctgacttagctgaactggtgaatatcggtactttgactgcctttaccctagtttccttctccatcttacggttacgtaaaacacaaccagatcttcggcgtcccttcaaaacgccatgggtcccgtttgtaccaatcatgtcaatcatctgttgtgtcttcctactaatcaacctgaagcctgtcacttggattcgcttcgtggtatggttagccatcggtatggtcgtttactttggctattccgttaaacactcccagttgaagacgaatacagctactgatgagaaataattgactagactaataaattcaaaactaatgggtcgcttcatttcagcgttatcaactggaatgaaacggcccattttttatcctctaaatacgaacaaccggattacttattgtactcaacttgaagtaaagttcacctaacgaaacgtaagttgaaacttgttaacatgagcaaatttttagtttgtctggttaaccccttttgaaaaaagctagtatagtatgagtcacagttctaattgaagtgggggtcaataattcatgcgtaagcaacggattcaggaacgttcattgattggcatgttaatcacattaggcgtcgtgtacggggacatcggaacgtcaccgctatacgttatgaacgccctgatcaatgacgcggggcaacttaagaatgcaacacctgattatgttatcggcagtgtttcattaatcttttggacgttgatgctcattacaacggtaaagtacgtcctgattgctttacgcgctgataatcatcatgaaggtggcattttcgccctgtatgcgctggttcgtcaccgggccaaatggttaattttcgtcgcgttgattggtggcgccgctttgttagcagatggcaccctaacacctgctgtgacagtcacatcagcagttgaaggcttaaagggattacccaaactgggggctttttcccagtacccgtggctcgtgcctctaaccgttacggttattttactggttctctttatgattcaagggtttggtactgccgtcgttggccggtcattcggtcccatgatgttgctctggttcaccgtcatcggcatcttcggtctgatcaacatcagtcaggcacccgtcattctcaaagctttctcacccgtttacgccgtacaagtcttattcaatccggctaataaaatgggaattttcattcttggtagtgtcttccttgcaacgaccggggctgaagcgctgtattctgatatgggtcacgttggtaaagccaacatcgacgccacttggccgttcgtatacacggctttgattctcaattatcttggtcagggcgcgtggatgttaacccattatcaggatgcggcatggcgcaatgccaccaatgtcaatcccttctatgccatggttcctgcgggcggtcaaattgcaatgattatcttagccacggccgcagccatcattgcgtcacaggccttgatcacgggctcttataccttagttgacgaagcagtcggtttaaagttcttaccacgtatgattatcaagcaccccagtaacgttcggagccagatttatattggtgcgatcaactggctgttatgtctggtcaccttaggaatcgtttggctatttcaaacttcagctcacatggaagcggcgtatggtttagccatcaccttaacaatgttgatgacgaccatcctgcttagccagtggattcacatgaagggccaccgggcgctggcgctagctttattattcggctttggcgcactggagaccgtctttctaacggctagtctgaccaagtttattcacggtggctatttgaccttggggctgaccctcgtcattttcttgattatggtcgtttggttctttggtaatcgccggcgtttgcgttacaaccaggcaaatgaacagattagtctgctagattatcgtaatcaactgatccagctaagccacgatgatcacctgccagtatttgcaacgaacttagtctacttggctaaggtcgaccatcaacaccgggttaaacggtcaattctgtactcgattttagataagcggcctaaacgcgctaaggtttactggtttattaccattaatgaaaccaaccgaccttatgattgtagttacagcattgacatgctaggcactcgaaatatcgtggaagttcaactcaacttaggtttccgtaaatcacagcacattaatttatatttgcgccaaattgtcacgaacttaattgcagatcacagcatcgatccccaatattcccgttacggaatcacacaacctcgtcaagttggcgattttaaatttgtcgttcagaatcagcagatcatggaccttgctagcaacccaactatgggccagttcgatcgactactaattggtggtcgcgttctactacaaaacatcaccccatctcctgctatctggtacggcttagcgtttagcgatgtcttggaagagacgattcctttgttcacgaaaccagcaacagacgccacactaacgaatttgacggtccaccatgcccgcacgccgcaacggaattcgcgccaaccataaataaaagactagtttcaaggaattcaaccttgaaactagtcttttattattaaaatctatcagtcaacacacttatgtttgcggcataaacattaccttagtgtcaataatgccatactgatttcgcatcacttgctcgattctttcactgagctgaaagctggctgccactgtcattcgtggtgacactgctataaccagcgacaaggccactaagctcccagaatactggacatcaattgcattgacctgattcacaccatcaatttgttgaatcgtattaatataatttttttcaacttgtggatcactgtaattaattagctgcaacccactgtcccgaaaaatttgtaacccagcggcaaaaataaagaatccaatcacgatactcgcaacactatctaaccaagcaaatttgaatagtaagaccccacttaatgagattaaagtgccaatgctcgttaacgcatcactaagactatcctttgccgcagccaatagcgtcgaattatctaattgttgcccaccgcgacgattaaagtaccagacgactaacataacgatgctcgcgattgcagctccccaaacagttacaccgctcactgcttgaacggtgtgtgacttaaacaaattactaacaccactcacaataacttgtaccgccataactaacataatgaccccactcattaacgtgaataaatcttgtaaacgaaatcgcatcaatcgattgcgacgttcggcctcccagccgtccaaagcggtcactttactttgatgtgattgatgattatgaatgccaccccagataccaagcgataacaaccccgatgaaacaatacccgcaaaattattaaacgcatccgcgtgcaaagattgcgaatgaccaatcgttgcaagcactagttcgattacaaatagacttaaatatgctatcgcattgcccaacagatgccacaacgcaccttgcattcgcttaatttggtcagcttcaatttcttgccagccatctaacacgggatgttgattatttgattgattaatcgtaatcgccccctcctaaacagattccaaccgctcactctaacacttagtcgtaataagtcaaccttataccacctagaacgctgatagcttaacactaacagtctgacttgtaattgtcactatcagcatctttaagcagtaattaattaaagctggcaccttcgaaagtaatccacttcgaagataccagcttacaattgtctttgataacctttacgcgcagtcacaagctactgttcatataaatcacccgcccccatacaaagcctgctaccggtaaagtacagttacaatcacactaaggttcacgtttcgctatttgagacgtcacgcgtcgcggctcagaattctgcacgcccaaaatgtctaggaagaatgaaacaattggaatcccaatgatcaagccccaggcccctaatagactttccataataatcaacgtaataaaagtgacaaagactggcaaatcagtccggtccgccattagccgtggatgaaggaaataagactcgaaggcgtgaatcaaaataaccaacacgatgatccagacaatccgaatcaagccacccgacgcaaaccccagtaaggttagcggaatcattgaaatcaacacgccagccaccggcactaagcctaagataaagacaatgatcgacaacaccatgatacttggcatcccaataatcatgaacccaatcgtcatcaaaatcgtattgatcgtacaaatcaccagttgcgtttcaataatccgccccagaatcataacgaatttatgcgttaaatagtaaacgttcgtgaagaactttttaaacttcgactgcaagaactggcggccaaagaccatcattcgtccccgcgaaactgcaaagataaaactcaaaaagattgccattaagacgtgcgtaaagccagttccaacctcactcagtcctttaataccggtgacgagtaacgccttcccgttttgaatcaattcactactatgaatggcttggttgacccatttatcaatattcttattcaataccgggtgattggtgattgctttagccagcatatctggaatgaccttcaactgatcgaccagggtaggcgccgcgtacgatagcgcaccgataaacaacgcaatcacgccgacgtagaccacaatgacggcaatccaataaggtaagtgcgttcggaggtttaaccaccgactaagcttaatgcccaaatacgcaaaaatcgtcgttaatagaacaactgtcgcaaacccgcgcattaaataaataatgatgattaataacgccaacgttaagtacaagtcaacgtcatcccgcttaaaaaaccgaatgattctatccataatttgcccccaatcgcatgttacttgcattatagcatgactatggattaatcccgcccaccgattccggccttaaattaaatttgacatttaaaataattaccagtatgataggtgtcaataattaaagaacgattaaaagatgagtaattggtgtcgctgttcagcgagtatcgggttggtgaaacggtatcggcacaaccaatgaagatggtcttcttcctagttcgttttggtgagtgtctggtgagcaacaaagtaaccagcattaactaaagccggtttaacaaccgttacccgcgttagcaattgccaatcatttggcagctgtatcgagtagactagttcactagcctagaactcaggtggtaccacggcccaacgtcgtcctgaataatgattaatattattcaggacgacgttttttcgttcccaataaaatttaaggagtttgatatttaatgacaactacaactttaaccgccccattccgttttgacgtcgtcggcagcctactgcgccccgctagtttgaaaaaggcccatgaacaattagccgccggtaccattacgcgtgatcaagaacttgaaatccaacacactgaaatcaaacgagtggtcgctgaacaagttaagctcgggctcaaagccgtgaccgatggcgaattttcacgcagctggtggcacttagatttcctttggggcttaactggtgttggcaagtacgactaccatcaaagctataagttcaagggggaccatactcgaacggataacgctgaacttattggcaaagtcgcgtataatcccgaccatccgttctttgctgcctttgaatacttacaatcaatcgttcccgctggcatacgcgctaaacaaacgatcccatcaccaactatgttattccgcgataatcggagtgacaattggaccaaattctatgacagctgggatgcctatttaaatgatctcgctcaagcttatcacgataccattcaacatttttatgaccttgggtgtcgctatattcagttagacgatacgacgtgggctttcttaattagcaaactcaatgatcccgaagctgaccacgcggcctacactaagtgggcgaccgatgccgttaaagtgattaacgcagcattagctgacctgccaagcgacttgaccgtcacgacccacatctgccggggtaactttaaatccacgtacctcttctcgggcagttacgacgtggttgcaccctaccttggccagcttaactatgatgggctgttcttggaatatgataacgaacgggcgggtggcttcgaagcgttagaccagatttggaaccatgatgaccacaaacgcatcgtattaggtctggttacctctaagtttccagaattggaaaagaccactgtgatcaaagaacgagttcaagctgcgaccactaaggtgccattgcgtaatctagcactatcgacccaatgtggctttgcttcaactgaagaaggtaaccagttaactgaggctcaacagtgggccaagttggcgttagtcattggtacggctaaggaaatctggctagaagcctaattacaacaactaaaaaagatcgagaatcaaccggcgcatttcaagcgtaatcgcttaaaaaatcagccagattctcgatctttttagttaccggttaaaccgggtccgccaccgtgccaagcgcggcgtcgcagtagccggtttagtcgccttagcaggcatgttcaatagaatcacacccgtaataatcgccatgaatcccaacgttttcaatcccgtcaagatttcgccaaacgcccaaattccaatcaggccggtcgcagctgtgccgactccggcccagattgcataaccaacactcagtgggattttgctcaatgcccgtgagaaactaaaaatcgctaggccgtatagtaacatgcccacaattccaaccaaggggtacttaaatccagccgataacttcaacaagctggtccccgcaatttcaacgccaatcgcaataattaattgaatccatgcacgcatcatcattcccccttgatttaaatgttcagtaaaatcgccccgactacgattgcaattaagccactcagacgtgagagactgagccgttcacggtaaacgacgaccgctaaaataacggttgcaaacgtgcccagtccagcccacatggcatacgtcacccctaacggcaggcgttgcattgcaagcgttacaaggactaacgaactaaaatatccaaccaacaccattatcgttggtattaagttccgaaaaccgtttgcgcgctttaagaaaaagctccctaaaacttccatgaaaatgccaccaaataataacccgtatgccatcttaatcacctcactaaaaatttcgttgtcctactattctacggaagtttatttaaaaaggcaatcaaaagatacgcctggctgattacagtttgatgacaaaaataaatcgtattatagactatgctacagcgatctaaccatttaatttcaaaattattgttagctgagtggcgataactcattcagcttaacgagcgtacacaatggttacgattcgaataccgtccagttgaaaagcctttcgcaataaaatgtcaataatcagcatttaagacgtcatccgcaactcaaatctcccgcatctaaaaaaaaaaaggaccaactcagcagctggtccccacagtcatccttaaatatagaaataaattgagaaaaacatcaacgtggttcccaccatcacgaataggtgccaaataacgtgtaaatatttaatccgtgggaaactatatagtaatgcacctaaggtaaacgcaacgcccccggcaactaataaccagaagccagtgacacctaaatggtcccataactgccgaccaccggcgaggcacatccaccccatcaacacataaatgaccgtttcgacctttttcaaacgtccaggccaaacagcattaaccgtaatcccagcaatcgctaaaatccaaatcgttaataagatcgtccagcccaaccaacccttaatcgccagtagactgtacggcgtgtatgtcccagcaatcagcacgtacacgccactgtgatcgaagatacgaaaaacttcgcgggcgcgcgtaaagtataatccgtgaaataacgtcgaacacgtatatagtacaaacaacgaacaaccatatataataaacgccgcccattcgaggggctgaccatccgcatatgccttgagcatcaaaaaaacaaatgcaacgatacttaaaataatcccaatcccatgagtcactgagttgaggacttcatttgttatttgatactgtcgcgccgactgtgccatgttaatcacctcatatttattattgacaccagcataccatcacatagtgtaaatatcaatacatctagtttacaaaactaggtaattaacaaaaacataactagttcaaaaaatgacactgcgaaattaaccatttcgcggtgtcatgctaagcacaatcttatattcaagctaatcgtgcggtcctctaggccatggatatctataccagtgcccactacgaacccacagcgcttaccactcatcataactgatcagcggtaacacctattcaacctaattatcggcttcttcagcgtgagctgcgacctgctgaaaaatactaatgatatgtttatcggccagctggtagtgcacgttacgcccattgcgcgttcccacaactaattttaattgtttgaggaccgttaactgatgagacacattcgactgtgtcagggctaatcccgtcgccagttcacccacactcagcttagatacggccaacgcgtagataatccgggcacgcgtcggatcaccaagtgccttaaagattgcggtgatccgactcaactcatcagtcggcggcatcagttcagccaaccgtttgacgatcatttcatggtccatttcattttccatcataaactccaatttctaattgagattgtcatgtaagcgtgttacaatacacatgaacagtcattcatatgtttgctcattcatatttaaattatagccataacaaggataaattcaactaagaagtaggtgattcatatggcacacagccatcaaatacaacaacagaccagcgccttcaagattggggtcgccctaaatactgccttcattgtcttggaagctggctacggttttgcgagcggctcactggccctagttgccgatgcaggacacaatctcagcgacgtcctgggcttactgatctcctggctggcaatctggcttggacaaaaaagcgccaacgataagtacacatatgggtacaaaagctcatcaatcttggccgccctcttcaacgccgtctttttactagtcgctatcggggccatttcagtcgaggccatccagcgccttagtaatccgggtcccgtcgccgaatgggatgtcattatcgttgctgctgttggggtcgtcattaatggctttaccgcattactctttatgaagggccaaaagcacgatctcaatattaagggcgcttttctccacatggccgccgacgccggcgtctccatcggcgtggtcattgctggcttcatcatcttgaagactggctggttctggctagaccccgttgtttccctgctaattgccgtcgtgattttgattggtacttggggactcttacgagatgcgatgaattattcactagaagctgtaccaaacaatgttgaccgccaagcaatcgctgattatttaaccagccagcccaccgtcaaccagattcacgatttacacatttggggcatgagtactactgaaacagccatgaccgtccatctctgtcgttcaacattagctgacaataatgcctttttggaacaactgaacaaggacctaagcgcccagtttccactaacccacatcacgattcagattgaacttggcaaggtggattatgaaacaacggatagttcgatttagttcatcttcataaaaaacgataccgcaacctcagcggtatcgttttttcaaatattcagcatttttcgacgttcgtacgttaaattaagacattaacgcacattgcagcacacataacgtcattcattatataatttaagtaatatttattaattcagataatctggttcacttcattcttagctaaccacctaggaggcacttacatgagcatcatcaatcgcgttatcggtatcattatcacgcttatcttgttatgccaatggttgcttggctatcaattaccagctgccatggcgttcttcttagtggcctggctgattggcttggtaacgatgtggctgttgccagacacgacgacgaccgctaaccgctagtcgtgtcagagggatacaaaatcaactcattctaaaacacgtcataagaccattacaacttgctcttgcgacgtgtttttgctaacttcactattacctagaaaacggttagactggttctacacgccagcatcaccgaccattcaaatatgtttttgccgcttaccctcattgtgaacttgcgcttcatattgcgatggaactaataatcacacttcccataaccactccggattaaagcccccaccttgcttacattcacacattgatactcacaaagatacgcaggcataagcaaataaaaaaggccagcatccgccagcctaattctacctaattcaatttaatcaatcccgccgccaacaaaaacatgtgggtgacgactggtccaacgaaggtcaaaccatgtcggtgtaaatccttcgcaacgcgggcgcccaggggtgagcgcgtcggtaattcatcatcgggcgccggcataatgattggtgtcgcatcgacaaacgcccacaggtagttgctaaagctaccatactcggcctgtaattgttgaatagcacgcgcatcttgaatgattgcacgtaacttacgaccattgtgcatcactttgggagtcaacatcagccgttcaaaatccggttcgtccagggcagctacggcgtctacccgcagccccgccatatgttgccgcaatactggtaactgactagccgcgacccgccagcctaaacccacttgtaagattccaaccactaacaattcaaataaaacgtgatcatcgtacgtgggagtaccgaagtaagcatcgtagtccttaaccccattcgccgtaatatcgtcaaaatcatccggactaatcattattcgataaccaatagccattctcaattcgacctaacagcgtaatcaattgcttggtttcagcaacatcgtggacccggatgatccggccacccttaagcatcatcgctgcttcagtgaccaacgtcattggtagccggtcttccttcttcaggccaagcaatagacctaaataacctttccgtgaaatggccaccatcattgggcgtcgcaaataattaaattcatcaatgttacgcatcatcacgtaatcctgttccccatgtgcgacttgtgaatagccgatcccctgatctagagcaattcgttcaatatcgatgccatgactcgtcaatgctgccagattttgttcaaagaaaccacgcatactgctcgtcagatcggtatattcttggtcacgactactgtgcatagtcagtaagccgacgcgactgtcagccatcaatttgagcttgcgaggatcgtccgtaaaggcgttcacatcgttaataatgctgacaccttcttccaggacggcttgcatgacatcatacttataagtatcgaccgctaagactgcttccgggaaacgagccttgatggcgcgaatgtacggcaacgtccggtctaattcaacttgcggcgtgacttccgtgaagcccggccgtgtcgtttgaccattaacttcgattacgtcagctcctgcttgtaacatggcatccacgtgattcagtacgtcatctttagtcttgtactggccaccgtcgaaaaaggaatccggcgtaatattcatgatgccataaatcatcggcttcttggtgagattaaaccggtgctcacccgtttgccaaaaaacatcatattgtttcataatttgggtcaattgaatttgagtcgttgcttgatccgtaaagactcgcgaccattggtgggttaactggcgaccagctgtctggttcaacaagacggtcaactgttcaggactcgccagcacgaccccatctaattgctgacatagttgggttaatcggagctgctgttcccgattataatcactaaaacgcaaaactaattgttgttgtcgttgaacttgggcattcaacgcctgactcgcaaaatccgttgcttgtgctaatgaactggtgatatcttgtactaacatctactccaccgatccttccaatttttaaagttttgtgattaattttaaggcggcccgtccccggtgtgtcagcgggatgcgccacgttgctggtaattcggccaaagttcgaccatagcgcggtagccagaaaattcggtcaaatcccccagaatagcgtccaaattgataggacgcaatgtagccggtgatcgaagcttgtacggccaaggtctgcccatctggccaggcagccgctaacgtagcacgcatcaacgcttgccgctcgttgtcaggaatatcgcgtagggccgttaaaatttcctgattgcgatcaaagccactgactgcaacccctaagtcgcgcgccgtggtcacacctaacaagtctggtaacgcggaaatctctaagccactatcatctgcgataaccggaacccctagctgttgcgccccaaaacgagctttagcaaccgcgttatcgacatagctcgtcgtcgtttccacgggaaattcgagccgcggcgccactgtcaagtactgacgagcagtcaagccatagtaagccaaacacgcgatcaagtcgcggcttttaccagcgttgttggatgcaatcaaccaagtcgtcgtcattggcttaaccccggccaaccagcctgttggagctcacgaatgacataaaatgaccccgttacaataatcgcactattactggttgcttgctgctgagcttgcgttaacgcatccgtgatcgtcgttgcagtcaataagtctggctgtcgttgcatcgcagccgtggtcataaaggtgggcgttaataatgcgttcgccgtgtcggccagcttagtcgcggataacgctcgttctggatttgcgggcgtattcgtaatcaggacgtcagctaccggtaatagttcagccagcattttagggtaggccttatcttgtaagaccccgacgatccaaatcaatttacgaccagcgagtaattgcttcacacttgccactagtgccgccataccatccggattatgcgccccatcggcaataatgacaggttgctcctgtaatacggtcaaccggcctggcaaggaaacttgttgcaagcctcggcgaaccgcactgttcgtcaagttaacttgttgctgttgtagtactgcaaccacagttaaaaccaaccgcagattttgtagctgataggtgccactcagtccgaccgttaattgcgtccaatcaaaaagctgactgtgcgcatcaacgacggtttgcgtgagtgtttgcccagtcaccgtcagttgcgcgtgcttagcggtcactagccgaacaccttgattgagcgcttcagtctgcaaaacagccagggcttctgggtgttggtcagccaatgtcactgctgttgtatggggcttgatgatttttgacttattttgcgcaatcgcggtaatcgtgggcccaagaatggcggtatgatcgagggcaatcttagtaaataccgtgagttggggactggctaaggcgttagtcgcatcatacaagccgcccaaaccggcttcaatgaccgcccattgcacgttttgattccgaaaccaaacgacactaatgagaaagaaccattcaaagatggagacatcgctagctgtcagtcccatattttgcagaaccggtagaatctcacgatacgtatcgataaattccgctggactgatccacgtcccattgcattgcagttgttcacgcgcatcattaatcgcggggctgctgaagcggccaacttgatacccttgcgcccgcaggatactggctaacatagctcccgtagagcctttgccattagtcccagcgatatggatcacatggtaataatggtcagggtggccaagatgtgccatgattcgccgtaataacggaacacgctgatgattattggctaacatggcttgatttagttgggctaataagtcctgataatgttgttcaatcgtccctgtatccactcaatcacctactttgcgattcgctgtaagaattctcgtttcaagtctaaatccgtcttgaattgaccactgtaatagctactttccgtatgcacacccggtttgctaacaccccgcatctccatgcacatgtgccgcgccgtgattgagaccgcgatcccagccgggtcaagaattcgttgtaattctgttgcaatggaaaccgtcaaccgctcctgaacgttcggctgttgactgcaatagtcaatcaagcgaggaatcttactcaagccaatcacttgttcatgctgcggcacataagcaacttgaaccgtgccaaaaaacggcaaaaggtgatgctcacacatcgaatagaatggaatatccttaagtaataccatttcagtcggatgctcaaccttgaacagtttataattatcaaatggtgcggcggtcttagtagcgaaaacttccgcatacattcgtgcaacccgtgctggtgtttctactaatcccggtcggtcaggatcttcaccaactgcacttaaaatttctcgtactgcatgctcaatctttgcttggtttttctcatcaatcatctaactcactcacatttcttacttttttaatccaactctgatcctgattagccgcaatcaattgggccacttgtggtccaactaacacatcagttttggcgatttcagcagttggcagtagcacaaagttgcgcttagctgcctgcgcatgcggaatcgtcagcgtcgctgtgttgatttgccggtcgccccaaaaaataatatccaaatcaatcgtacgtggtccccagtgaaccaagcgttggcggtggcccgcctgctcaattgtatgtaattcatccaatagttcttctggtgtcaaattagtcgttaaggataccgaaacattgtaaaaattggcctgatcacgctttccccacggttgagtctcataccaatgagattcgtcaatcacgtttaccccattgacggctcgtaatcggctaagggcttgctgaatattttggacgcgcggatgaatattggaaccaacactcaaataaacccgttcttccctacttgccattcggcgtcccctccacctcaatttccacatcatcaaagattccaggcattggtacgctatatttacgaattttaatattgattgcatccgccgcgggaaaacttgtcaataacgtctgcaataagtggttagctagtgattcaatcaacttgtatgaatgggtcgttacaaattcatcgaccacgttacggaccgccgcgtaattgatggtctcgtgaacgtcatcgtgttgaaccttggtttcgataggatatttaatggcaatatctagccctagttgttgaccattacgccgttcttctggaagtaccccgttaaacgtgtgaaagcgtaaattattaattcgaatcatgcccataagtatcccagcctctttcttgctcatttttacttataatcatagcatgaaggacgctcaatatgatagtaatcagccaaataaccccataaaaactagcaatcgttcgggaaccgaaaaaagtgcgttgctaacaaaccggttcatcaaaaaagacgttgctggtcaaaaaaccagtaacgcctttgtcttagtttaaagcagtcgtacccccaccatgaactctaggaatccgtagtcgtcccatcattaaaattaatcaaattactgaggtaatggctagttagaccaggtgtctgcttcacaatataggtggcgagcggtgactgcgtcatttgcgtctgaataaagctcgtattgacgatgttcgccaacgacaacgcgacaaaaataaccagatacgtcacgacaaatgacacgattccacccgcaacactgttcacttgcttaataactggtagccacgtaatgctacgtgaaacacggcctaacaaccgaatcactgaccaccctaacgaaattaacacgaagaaagcgaccaggttaatgatcaacgttgccgccactgaagcttcaattaaatgtaaattcgtcaatagattactaatcattgtccctaacggctgatagagtagtcgtgcaaacaataggacgacgaccgtcccaatcagatgcaacatttcaatcacaaatccgcggtgaaacccgcgaaaaattgcgcttgctagtaaaattaaaatcacaatcgtaaatatcatctgcgtgccccgccttccgcttttcaggtacgcctattttaccagctttcgtcagtcagtgcagtgttttcacctagtctaaaccttatcttaaagacttgacgacgaccgtttctttcggtaaagttaacagtaatggttacgatttaaaaagaatggggttacaatacatggtcaaccgacggatatggctttatttggcaataatactgggactcagcggcctattagcaggctgtcaaagttcgagcacccccagtaaaacgactaacgacaaaattaatatcatggctagtctcgacttttatggtcaaacagctaaggcggtggcaggaaagtatggtcaagtgacctcgattattgatcgaccgagcgttgacccccacgactacgagccgaccgtcaacacggctaaacaggctagtagcgcccaattaatcatttacaacggcctcggctacgatgactggatggaaaagcttactgtcaacaaagccaagggcgcccgggtaatcacagtgggaaccgacgtggctcataaaactgacggggccaacgaacacgtctggtacgatcccacaacgatgcccaaattggcaactaaaatcgcaacagaactcagcaaaattcagccgcagcacaagcattattttgaacagcaggcccaaaagtatcagaccaacgctaagactataaccactatgatcaaacaattgaaacagcatgcaaataatcagcgtgtcgctgtcagtgagccggtctttgactactcattgaaggcaatcggctaccgaatcagcaatacgcatttcgcacatgcaattgaagaaggttccgacccatcacctaaggatatccagcaaatgcaacaagacatcaagcaccaccggattgcctttttcgttgaaaacactcagaccgatagtaacttggtcacgaacatggtcaaactcgccaggaaatacgatgtgccggtactgaaggtcaccgaaacgttaccggccaaccagacgtatcaaagctggatgctcagtcaatatcgtcaattggcaaagattcaaaaagcaacagccaagtagaagcgccccggttagttgggccaagtcctgtgattcagtacgatcacagtcgtgccacgaaaaaagggccgccattcttgattacaagaatggcggcccttttggcctaattacgactaaccgaccgattgtgcaggcactaatgtctaattagtggcgttcaaagcatatcccacttaacttcagtcattctcgcctggtagtcagtcaccgtgattattaatgcgactgcttgcgcccatcacgcaaaagtaacgcaagcacgaggccaaccaattcaatgccgagcatcatccagaagaccgtatggtacccttgcaagttcgcacgcaacgttgaggctcccgcttgtttctgagcaagcgtcacgttggataagaccaaggtcgccacggccacaccagctgaaccaagaatttgacgaaccgtcgtaatcacagcggtaccgtgtgaaatcagttcatcgggtaatgaattagcccccaatgtgacggcgggcatcatgacaaaggcattcccgccttcaattaaggcagccagcaaaatcatggtgagcaggttcaactctgaattgatcagtgctaagatcagccaaccaacaacgatcatactcataccaagtaacatgatttgtttgtatccaatcttctctgctagtttcccagtaagtgggttcaaaatacttagaagcaccgcaccaggcaccagtgacatgcctgaaacgaatggcgacaccttcaagacaccctggtaatagagtgggaagatgattgttacgacaatcagcgccacgtacgagattgctgttaggaaaatggctaagtcataattaaatgtttttaagacccgtagttccaataacggcgtctccaagtgaaattggcgataagtaaagtaagccaccgctagtactgaaaccgctaataacagccaaccgaacgtccagttcacattgggtttaccaatctcattcacgacgtataaaatcccagcaaagcccagtaacgtcacgattgagagcaaatccagctttgaaggcttattgaccatcacgtccttgatcgttgtgaaactaattaggatcaacaaagttgccaccgtgatgaagacggcaaacaatccgtgccaatcggtaaacttcaaaaccacaccggaaataatcgggccagatgctaatgctgatcccatgaccaacccggcgacacccatcgtactaccccgtttttcctcgggcgtaatcgtcagtaaaatggattgatacgagggaaacagcacgccaactgccgccgctttaattaggcgaccgaccatcatcacaccaaaactgggtgcgaaataaataatgattgaaccaatatcgaaaagcaccaaaacggctaagaataatttcttaaacccaatattattcaacaaccacggactgattggcatcatgacgaccattgtcaacataaagccggtcgttaaccattgcacggttgaggccgagatgccaaagtcgcgcataaatgttgggtagaccgtcgacaaggaagactgactgatagacatggtccaagtcccaagcaacagcgtaaaaatgaaccagaagcgtcgacgccccgtcaacgttacattttgattagctgtctgcattcaaaactcctccttactttagaacagttatcaactaataatatccattgtaccattgaaaccaatgatgtacaggctaaaagtcagattgccaacaaaaaagtttgctacaccaaataaagagacgtgcacaattagcttgtaacaacacccgcgtgaatgattgttaaatatccaatctgttaaaactctaacggacagattcattaagtcagttgtcctctaatcatcataaaatcagtcccaaccagggcactccatcacaccgaaaagctttgcagccaaactaaaaatgggttgttcaagaatcaaattcttgaacaacccattacctacatgttgcatcgatattcttaatttattcagctaacatggccgcactaactgcctgtagctgcttcgcttcaccagcagtcggtttagcgggtttcatcttctttaaggcgatcactgcccgatattgaagttctgccacattaatatcatcccgcaaatcataatgagtaattgtgacgaaggcggagttctcataaattttttcaactttagcataaaaatcataatcggtattgccgttcttttgacatttaacccgatcccccacagaaatctgagccataactatcactccacttcataaaatatgataataacatagcacgtaactgctagaataacaattattgctcccgaatttacatgatttttacatggttatgacggatactgtccaaattaaatgacattaggcccacgagcccgtattagcggttagtaatggccaagttcgtaaaccaatacctagtaccttagactgagctgaatcactttatcgcttgaaactagcatcgatttttctaaccaaccaaacgtacgccatttacgcctgactctcaaaatccgaacgctactgtctctcgttttgacagctcccccatcactgccagctaccccaaatatgagcattgagcgcaatcgctaacgattcaactcaacggaaacttattcagtacaatgagtgtgattgcaaccaataagtagatcgtgccggtgattaatagtatgggttgaattccaaatgcgctgatgagtaccgggattcctaataatccgacccgccgtttgaatttcaaaatttagtcttagttcgcccagtaggctaatttttggcaacaaaaaaaggaatcgaattaacgattccttannnnnnnnnntttcaaagatctaattccgtgtgttaatcgcttaacacaacttaattatcataacatcttaatcaatatcttgtcaacaactttttttaagaagtaacttgattaatttgtcatagttgccgttgcgacaacagaaactatcttaccaattactgaagaaattgtcaacaactaatttcaataattatttggtggtgagatgcatctgccgtagcagcaacgtttactaatataccaattgaagtaaaaagtgtcaacactttttctgaatttctttttattaatagtcaaaccagctttctttctctatactatttaattaaaggagcgactaaattatgctagcttggctaccattctttttgatttcattaatgtttattgttctactatacgcttgtgcgcgatcagcgcgcacaaatatccagcgttttaagcaactcagtttaattgcctttctctgggtcttaactgctttttgctatacacctaccagttacaattttggtacccaactcgttattcaatatattcaatggggacccgttaagctgaacgtgattcctttccaacaacttgacattgaattttggctcaacgttctcctcactgttccattgggcggtttactggcatggaattttcccgacttgccttggcgtcgttttatttggttgggatttcttacggggctaacactcgagctgggacaattcatccttgactggttggttaacctcaaacgttgggttgatatcgatgatgtcatcacaaattgggctggtgtcattatcggtgccgctggttataaaattgcacgtcatgttcccggacttcgctggttgcaaaaataacgtgtatatagaagcaaaaagcaaaatagcgtttgtttagcacccacaagtgccaaacacttcagcggtctagctgtcatgaaatcgtaattaaataagcgtcgcagccttaagtggctgcgacgcttatttaatttaactactaactattaatgaagctgccatcatcaggattcaaaaaacagatcgaatactcgcttacgatcttggttccagacctgattgtcactagttggataaactcgatttgttaacacaaccagcccaatttgacgatccaaatcaaaagcaactgccgggccagtaaaaccagtatggaaatattgatgtcgtcccgcacgtcgttcccaacctaacgtccggccattttcgtcatactcgcctaaccagtcaaagacattttcatccagcacccgtttgccttgatattcaccaaagtttaacatcatttcaataaatacggataaatccgtcagcgttgagaacaagcctgcgtgaccactctcaccattcaacaaaaaggctttataatcatgcacctgtccttgaatctgaccccgccgcggatcaaactccgtcggcacaaaccgaatcttcggacgatttaagttataacccgtattggtcatcgctagtggatagcaaacgtggtcttgaatactccgagccaatgagccgtcaaccgcacgaataatccatcccaataaaataaatcccaggtctgaatagacatacgttgtccctggtgccgtgacgagtggcgcatcataaaccgctttgatcagatcttcacgttgcatcttatccaggttatcaatatctgccggtagcccactattatgaagtaacaagtttttaatcgttatttcaggatgagtgaacccaggtaaaaaccgggcaaccgagtccgttaaatgaatcgtgtggtccgataacaactgaaaaatcctcgtcgtggtccctacaaccttagttaccgatgctaggtcataaatcatcgcaggatctaagcccacggcaaactcgtcgcggccctgcttaccatgatagtattgattgatacctttaggggtgatcaagctaaacgacgccccataaatgtcgccagcttcaatacaactgtcaatatattgttcaattttttcgagcatccgcattacgcccacctttcactacattcactagtttctgcttatcttctttatgataacgaacttcctcataaaatcaacggcaaacgcttttaacaccctccacacctcgttgcactttttattaattaactagttaaacacttgttacattatggacaatattccacttatatatcaaaacaagtcttgtttttagccgttttctaaatataattaagtgaattaccaatgcctatctagctatgtaagtactgttatatcaacgttaatagtcaacttttcaataatagattgcaaaaaaataacccaaacgtgaaataaatcacctgaaagcggttacaaatccaacaaaaaatgttatgattcaaatatagaattttatcaatcatttgattggattcaaattatggaggcgagaaaatgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagaccgctttccggatcttaaagactttggacaacatgggcgccgcaccagaaccaaacatcacgatcttatggtcagaccgcttaccagaagacttcaaacgttacgcaactgaagtttcaatcgacagttcaaccattcagtatgaaaatgatgacttgatgcgggtacaatggggtaccgattattatggtattgcttgctgtgtttccgcacaaccaattgctgatgggatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggactggttagctgacacttacgttaactcactgaacgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacaccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctactgtgtctacttcgcagatttaaccaaggaacaacaagatgacgttatttcacggacattcttcgaatcaatgtaacatttaatctttaatagttaagaaggcgaaaggctcatggaaaacaaacaagtttcaacaacgcaagcggcggcaaaggagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacacggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaagattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaaatcggcatttctagcatgactaaaacaccagcgatacaatcgtctacggatggttgtgtcactggtgtttttttgctggctcgacgcatgcacgtattgctggctggaattagtacagtggcacgcaaaaaaggcgccgcgagcaaaccagcaacgtctttccttaatcatgccctatccaatgaccgtcagcccttggactggctgcgaacaggccggccactaactatgaatgcctagttccattcgagcttcgcgggacatcatactttcgttccaagcaggttcccacacaatctcaatctcgatattgttaacttctggtaatttgatcagttcatcgtgaatgtccttagccaaccattcggtcaaaggacagcccgcaatggtcaacgtcatggtaatttcagcggttccttccgccgtcaattgtgcatcatagatcaaccctaagttaactagatcaattcctaattcagggtcaatgacatgtcctagcgcctcgaaggcccggtttttaaacgttgttgtcatcgtatctcgtccttccataccagcttgaattcactgattaatcacgccaacgtttcgcggtataagtgccaccacacttgatacacgtcatcgttatataaagcgctttcttgtctacttctattgtaccgtatgtcagcccatattcaatcaattattagcgctaattagccgacttttcaaacgatcggtcaatcagcaaattatgcgactatttctcgaaaaaatttactataatccccgatatagcagcgttttgagtcactattgatttttattgcgaattcgcggttgtttttgttgtaagcgtttgcggtttatgctattatactaagtgaggaaaggaattaatcctcgattagcaaagcttctcaaaagagtttggctgtcgctgtaatgttagacagctagtatcacagtttgggtcgttatcgaaaccgttttaagcgccgtgaagcgttatcggtctagcgagtgtcgtgagatttacgttggatgactgaacgttgacccttagataaacgataaccgcaaagaattaattggcattagaatgacgaacagattttaactaagttttagttggaaacaggtgtctccgatgaccagttgttagttccacattaccagctccatttgtagactcaggtattacaaagtttaaacggaggtgcatgtctgttacgaagacattcccaagttttaaacgcgagtttgactttcgttaaaacccgtctaacgagtcgcaatcaagtaacaaccttactttagatcgactatagcagatagttacaataaatacgggttagtccgttagaagttggacacgcgtaaaattgaatagcatgaaggtgtatcatattaacactgaacaatttttcattgctaatcaggattattcctcataagtagaactcaagcagagaagccttgggttctatttttttgctctaaaatcagatttaccaacagtcggcaccagacgtaaccgtttacatactcttacgaaaaccgtatactgaatttaaatcaagttgcacattgaggaggactttagttttgaaaacgattaatttaggtcacagcaatattcaagcttccagcgtggcgcttggcatcatgcgcatggacgccttggatgtcgctcaagccaccaaggttatcgataccgctgctgatttaggcatcaattacgttgattcagctgatatctacggtggtggtcaatcatcgaccatcttcggtcaagcactcaagcaggctcacgtatcgcgtgatcagctctatattcagtcaaaaggcggcattgttcctggcaagcgttacgacttttccaaacagcacatactggcagccgtggatggcgagcttcaacgcttaggtgttgattatctcgacaccttcctcctccatcgaccggacgccctgatggaacccaaagaagttgctgccgcttttgacaagttgcaaactagcggcaaggtgcgccactttggcgtctctaacttcaatcccatgcaagttgacatgcttcaagcggcactaaaccaacggctcatcatcaaccaactccaatttggtatcatgcataccggtgcgatcgactttggcttgcacacgaacatgcaggacgaacgtagtcttaaccacgacggcgagatgatcgaatactcacggctccataagatgacgattcaagcttggtcgccttatcaatacggtaacttcgcgggtatcttcttagacaatccgaagtttccagaacttaataatgccatgcaagcactcgccgatgagaaacaggtcactaaatcagctattgcgaccgcatggattctccggcacccagcccacttccaagtcatccttggtacgatgaatccggaacatctagctcaaaatgctgctggagcagacgttacgctttctcggcaagaatggtatgacatttactttgcagctggcaacgatttaccttaatcacgatcgacctaacagaattgacgattagtttttacaatcaaaacgacgaccccaaatcaggattgattttcaggtcgtcgttttttagacgtttcactaacatttttgatgtactcaccacatctacgcgtatacttaatcttatcaagactcaggaggcgagcgaatgacatccacttgcacgatctgtgaacgaatcaaactaattcaggcacatcagaatccttatttcgtttacgaactcacaacgggctacgtggtccttgctgatagccagtactttgaaggctacacgctctttttagccaaacatcacgttaccgaattacatcatttaccggcacacgagaagttacgataccttgaggagatgagtatcgtccaggaagcttgtgcgcaggcctttcatgcagacaaaatgaacattgaactactcgggaatggtgacgcgcatgttcattggcacttatttcctcgccataacggtgatacgcccaaccccggtcccgtctggtggacaccgctggaaacaatttatggtgatgatgtcagtctagatattccccgtttaagccggttgaagcgcacgctcagcgtagcaattgaagccacgcttaatgctcgggaagcagaattgcaggctttagaggcactcacaaggcctgctagccacagaattgacagcaattagaccaaatcaggacccagacccgcttagatcttggtggctacaccccaattcttaatcgcaatccgtcaccgtatttcaaattgccaaaatccacctatttatccggccgactatcatacgctcgcttagatttatagccagctcgaaaaaccgtcttcataacttcaatgtgccgttccttagttgcttgtgccttagttccaaaaataaagcgggcccattcgcgctgataaccaggtgtcaaagccacaaagaacgtttgcaattcagcatcaaccgctaacaattcggttaccgccggaatatttttttcaaatgaactgaggggtgctgtactcataatcaaacctccgattagttttacttaaatttactgtaagaaagggaaaatccctaattttcaggcttttatatttcgaattttcacaaaattgcgctatcattatagtataagtattattatttgactactataattaaccatactgctattcaccaaggggagccctgctatgccaaaatttgatatcaccctcatcagtcccgaacgcgctaaagcgatgttgactgaatacaaagaacaacgtaaaaactctgtcccacatctggcccatcctggccgctatatcttgccggattacaaactaactcgtcgccgggccgcattcaaaattgttaaacatacctttttaacgccccactacaagtcttacgttgccatggactctgacaacggccacacactctggtttcataatttcggttccctaaccgaagctttattctggttagaaaccggccttaaaatcagcgataccgactcccattctaactacaaggaatggatggctaagcacactacggaaatcgaaaccttcaaagacttgctgcgcgagcagaagcataaacaagggcccaagactaagaaaaaagccaagtagcccgttttgacacctagattcagataagcagcagtacgctcattagcgtgctgctgcttttatttacgatcaactgtgccattcattactgactaggccaacctaaaagtggctatccaaaaacgactgcagcttgcgtgcaatcacgcgatgaccggcattgttcggatgcaaagtatccaccgaataaatggccgcttgagcgggaatcgcaaacgtcattcccgcatcacgatacaagctcaaatgtgggacgccatagtccgcagtcatctgggcaatcgctgcttcataatctgactgacgatacccgagaccattagtcaccgcactaaaactgcccccaaaatcagagccaatatgaattgctgaaataaataacttcggcacggtcggccaattcgtctgtaatcccgtcagtaacatcattaacgcgccataaaatgtcgtcatatcgcaatcaccgtattgccctaacggctgatcccgaccatagtcattgacgcccccaaagacagcaataaaatcagcatcttcaggaatagcttgatagcgcgccgccatcgcatcgtagcgactcccaatcgttgaaccagagattcccaaattatcgctccgctcgacatcccaatcagccgccaaaatatcatgataatgcaccgtcgccaacccattattcgccgtaatcgaatctcccaaccacgccggccgcttaaaactaacgtgcccattactaatcgccatagccaatcctccctttactatcatcgctaccattctaatccatcccacctgaattatggtagaaagatgcctttatttaaagtcaacagccaccagcttaggcccgctggaaacagttccggttagcgtaaacctgcttagttcgttcgtcctacgctgccctccaggcatttctgccaatnnnnnnnnnnccggaggtcggaataggacgctcaccggctgacgaacagaaaaccaaccctaaaaggcatctttctaccattatttcaaacaggtgggccaatcttaaaaggctcgtattatggaaatccataatacgagcctagtttaattgatatatttagttcaactgagtagcgctaatcggcttccgtttcacgtttccgtgcagtacgccgttcgcgtgcgtagtcagttttagttgtgatttcaacgtcacgtgctagccgtttccggcgtgctaattcagctgctttggcattggctttcgcagcttccttgactagatcagtcgttaagtcgtgatggatcgagtacagtaagacgagcgcgacaatcgttaatgggaagccagacatcgcacagatggactgaatcgattcaaagccaccgaccgtgacaagccccaatgagaagactaggaagataacgacccagctcatccgattgaaacgacttggttgttcccccgcggccaactttttactagtaaatgacgaggtaatgaaggcaaatgaagataccgtcgttgctaagaaaataaagcaagataggcagtacaaagccagcataatcatcttcaatggtaaggtcgacaatactgctgcaatcacagcggcttgtccttgcgtatttaagatatgaactaagttaacgatgcccatccgttgcaagtataaggcataaccacccaagatggcgtagaaactgacacaacctaatgagccccatagcaacataccaccgagtacctgacgaatcgtccggccccgagagatccgggcaatgaataagcccatgactggcataaaggataaccaccagccccagtagaagatcgtctgccgttgcatggccgttgcgtgaccatttggtgcagtattcgtgctcaacgtaataaacttattgacaaacaagccaatactattagtttctgagtttaaaatatacaaagttgggccaacaattaaaacaacgattaggaagccaatcgctaaccaaacatgggcagcacttagccgaccgattcccttcttcaagccattaaaaacagccatggcgaaaattacgaataataaggcaaataaccctaactttaaagtcatcgtatcggcaatcccggtaacggcactcaaaacttttgaaatgacggggatttccatcccgactgaagtaccaacaccacccataatcccaataataacgagaaaatcaatcgtgttccgggcaatttgcttacccttaccaggaccttgtagtactgaaattgcggcactgagccgctgaaccttgatgtgtttaacatacattgcataggcaattgcaatcgtggctggtgcaaacatcatccacgccattggtccccaattaaattgtcccagcatgtgcgcataattatatgcagaagttgaaaacggcttgacgccgaatgaagggctttggaggtaccgtaacgggtcaaccatgctcaacattaaaatgctggcatcgatcccggtcgcgtaaaccatactgccccagtgatacgttgaaaattctggtttgtcatcaggatcaccaagtttggttttccctaacttactaaaccctaagtaaatgaaaaagataaaagtgatcacatataccgacatataaagccagctcatgttatttgtgagccagttcaagatgccacttaaactcgtctccagcgaatggccccccattaataaaacaacggaagccgccgcaaagagcccaattgttggtaaatagacccaccaatcaatattcttactttttaaaataataaacctgctactgagcatatactctctatatttagatcaaattcgtggttcttcctaccagcaatggtagtccccacgcgtaaatttccgactagcaatcggtacacccctccgagttaatcctcggagcactcagcaccctgactgtatcaggtttgaccggcattgtcatccgcattctgtttgtgctaactcaaaatcagtagcagaatttccttctttccgttggttgaatccggacaacgccatactgacaaatgatttttaattgcttaatcgacgttggtgttcatcttgtttagctagtgtttctattaccatcgtgcctttagcacacgaccgtcgtcacaccacgtaacgattaatggttacactgctcttgctaatagataacccccttgaatcaccagataagcccaccgcacaactgttagattaattgcttggtgcaccaaaaaagcgcttagtaccgggtaacaagttaccacctgcacagcgcacgttggcttatacaaatgctgatttcagtattttctgatatctgatgttcgtttataagtatactagtattaaatcagaagtaaaatcaaccattttgagccgtcgaggcctaacccgtcaaggattagacgagttttacacccatattttttctgaaactttttaaaagttttcgtaataattagtttttagtttagaatcattcttatctgtttcaattaaaccgatttcatgttattcttgtaacaagtaaaaaaacgttatcatctaaaaggaggggaactgcatgcggcactactataaattaattttaacggtcagcgtcggtatcattgcggttattttacagtttggtttgcactaccaattggcagcacaaatcatcattacattaatggggtcacttatggccttatcaatgttagttgagatgatcaaaaccttacgttcaggtaagtacggagttgatttattagcaattacggcgattgtggcaacactagctgtcggcgaatattgggctagccttgtcgttctaattatgctcactgggggtgactcgttagaagattatgcggccaaacgagcgaataccgaattgaaagccttgctcgataattcaccacgtattgcccaccgctcagtcgccggccaattaacagatattgccgttgaagatgtccaaattggtgatcagctagtcgtcaaacctggtgagctagttccagtagacggtcaccttattcaaggaacggcactctttgatgaatcttcattgacgggtgaatctaagccagtcgacaagcacgttggcgatgacattatgtctggtgcggtcaacggcgatagtgctgttacaatagttgttgataaattagccattgatagtcaataccaacagttagtcaaattggttaaagaatccgaatcacgaccagccaaattcgtacggctggccgatcgctatgcagtcccattcaccttggtagcatacgtcattgccggagtagcttgggcattcagcggtgatccccaccgatttgcagaagtcctcgtagtggcttcaccttgcccgctgattctcgccgcacccgttgcactcgtctcagggatgagccgaactagtcggaacggaatcgtggtcaagactggggacatgttggagaagttatctacggctaagtccgccgcgtttgataagacggggaccattaccagtggtcaattaacagtcaaccaaattgttcctcagcctggttttactgccgaacaaatcttgcacctcgcagcgagcgctgaacaaaactcaagtcatatcctggcccgctcactcgtcaagtatgcgagtgccactagcctcagcccggcaacacaattagcagaagtaacgggtaatggggtcacggcaacgattgagcagcaacaggtcaaagtgggcaaacttaaattcgtcgcaccgactacaaccgccaagccacttgctactactgctatctacgtcggcatcgatgaccagtacgcgggttacatcacgtttatcgacaatgtccgccccgaagcagccgccacgcttcaagcactccacgctgagggcgttcaaaacgtcatgatgcttactggcgaccaacaggcaattgctgatcatattgccgccgatgtcggtatcgataccgttgctgccgacctcctacccgcagataagattgcccacttaaaggctgtaccagcggccgaacgccccgttatcatggttggtgatggtgttaatgacgcgccttccttggctgttgctgacgtcggcatcgccatgggcgcccatggctcaactgctgctagtgaatcggccgacgtcgtcatcttaaaagacgatctcagtcgcgtggtcacggcggtgcgcattgctaaagataccatgcaagtggctaaacaagccgtttggattgggattgctatctgtacaatcttgatgttgattgccagcactggtatcattccggcactctttggcgctatgcttcaagaagttgttgatacggtctcaattctttgggcgctacgtgcattacgggatcggccacaatcatcagtctcatcaacaaccacaactcccataacaaaggatgtgagctaaccatgccagaatggctcttacgatgggcacaatcggcactgacttttgtcgttgttttaacgttcgtttcagtcgttttactcaacgtaccactaaaagaagcaattctcgttgattttgcttacatgctattaacgctcgccttcgattggtaccgcagtcggcaccatgcctcgcgctaattattcaatctaatagtcactaacgatggttttaccaatcattaatcaaaaaaatcgttcccagatgtcttcttgggaacgattttttagttaatgctcaatgcttcggtttagggtgagaccgtccacttacattcaagccttacttggccaacatataactaacttttacgtcgtccataatcgtggcaagtggtaccacatcatcaagcaaaattgaataccaatgtttcttattcatgtgatagcccggtaaataatgttgtccatcaatcagcatagataagtcttctgggcgcgctcgcaaatctaatactgtcacaacatgtgttgcgcccggcaacgccaatttatcggaagttaccgtcaataatgcgccataccatttgtgcgtgtctgagcgtcgccaaaccgcgttttgtggaaatttaggccacaagaactcaagatcgtcaccataaacagctttgacttgcgcaatcagcttacgctccggggtcgattggaagacgtcattatcgtaacaatgctgttcgatgttgtataaaacatcttgataggcctgcgctacttgacctacaaactgaccatgggcttgggatgtcaggtgtaaaacatatacttcactagtcgtcgtatccgttaatgtcgtgttcagactgccatcagtgttcaactcgattatcatttcaaattggccttgcataattaaagttcggaactgatactgaccattctgattgggttcaaatccaaactgactgagtttgctcatattgacccgtttattctcaaatctaactgttgccatctgctgcgcctccaacttcattcccacttatcctgaatgtgatgctcgactattgcaatccacaaacaagtcaacgcactcgttgtcgtttgatagccgctatatcattttataagtaatcacccgtaaagccaattcaattgaccattgctgtgttagtaagccgacctttcacaacaattaccattgttccaatcagccaatacttgcgctaaagctcagctaatcttgaaaagacttcattaattcgtttatattgtttttttatacccgtccagccacaatctatggcacaatagttgataagtactggcaattgatgacctacttggttctttaaaccagcataacacaatcattttggctcgtggtattaacacatacatatcgttggttatgacctgaccctgtaccaaatatctttttggtcagcacagaaccatgtctgcgctgaccaatttactaaataataacggaggtcctaatttgaaaaaatatcgcgattatcgtaccgccattgcccgaacattaaccatgattcaacctaccgatgaaggcctcgccaagggtgccaaagcgattcaggaaatcttaaacctggcgcttgatcctgataccatcgtagattcggataatacacgcatagctagactagccactagtaacgcacacaatgagaccagcggctacgcaagcaaacgcggaagattcatcatcatccgtcaaaacaacttctgcacaatccaatgggcaaacaatcatgcaagtaaagcgcgatttaaagggttttgatttagtcgaccccaatgatccgaccggcacaccacgctaccactacgatgaaattttggcccgacaactggtgattcaccacgatgatcaggtcctgttagaaaaaaatttacggcaacatcgacaaccttatattgataaaatcgttagtcacgctactacagcggatccgattactgtcgcaccatttttcgttgttcattatcaagacaccgatgatacttatcacatcgaacaagattataacggcacaaccttatcgtcgctcaatccggcaatgaacgatgttacgtttactagtcaagaagcgcaatatcagcgcatcagtaatggtcaattagtcgacctggcttggtataaggagcggcctgagaaggtggttattcgttacgttcatcatagctcgagtcaaccgacctcgaataaagcagccaaactagctaaaaaggctactatccacacaaccaccgtgccagtgacgctgcgcaccttagactttgatctgcacgaaaaaacagttgccatcgtcatgggcgacgttggtacgcgccgaacacagatcacgcaactcattgatgagcacaacgggcacaccttattgattgatgcttttaaacacagtaatagcaccaacttctattaccggcaaatcggtcaagcagacctcgtggtcatgattcagaatcagaataaacacgccacttccaaaacactgaataaagctgtcaagcattacggtattaaaataacgattgctgatggcggcgggctgcagcagattgaacgagccgtttaccgcggaatcgctgatcttcccgcttatgagagtggcaatcccattagctacccccgcattaatgacgcttcacagtagcagccatttagcccattaaaaccacagtaaaagccccgcagcagctaactaaaacgtttagctattgcggggctttaaacatatttcggcacaagccttaaactacatcgttgttcagtagcagacacatcatagcctaatttcagtcaccgaacgattgtacttaaactgtttggcgctggttatcctgaatcgcaactggaataaagtcaaaggtcgcgtaatcgaataacccccgtgccgttaacttcaacgttggaatcacgggtaatgtcaaaaacgatagcgtaatgaacggatcaaagctaagtggccgctcgctaatgacctcatacgctcgtttaagttcggccaactgttcagcaactttttgatagctcgctgcagacagcaagcctccaatggcaagcggcatggtcgctagcacttgttcattgtcaacgaccgcaattcccccgttatcttgggtaatctgggctaccgcccgtaagattgcggcatccgacgttccgaccgcaacaatattatgagcatcatgtgccaccgtaccagcgatagctccctgtttaagtgcgaagccatgaactaagccgacgcccaccttgcccgtgttatgatggcgctcaatgacaaccattttgagaatatcacgttggcaatccgcttcaaaattctgcgttgcatcaatcgggagcgttaagtgatccgtctcgatatggttcggctgcacaccaattacatttgccaacccggtcgctagtggtaattggaagtcggctagttgtgcatggtgctgaacacgcgttgcagtaaacggcaatggttttgtcgtgcttggtaatatccactgtccccgcttcatcgtccgcgcaatcctaacgtgttcgagatcatctaagaccactaaatctgccaactgcccggctgacagactaccccgatcacttaaacgatgcgccatcgcgccgttgagactagccaatgtgtaggctagttcaggacgcatcccgctctgcatagctaggcgcacgttataatcgatcgacccttctgtgagcaagtcactaatcgtcttatcatccgtacaaaaagcaaaccggctagcattagcttcggtcactgcaccaatcgtcggcaaaacatcgcgttcaaccgtcccttcacgcaagaaaacagccataccagcccgcacacgatcctgtgcttccgccactgtcatacattcatgatcagtatccagtcccgcattgcgcatcacattgagctgatgcgcattcaaaccggcagcgtgaccatccgcatgatagccatacgcataggcatcactaattttagccagggtgtcagtatcaccacgcgcaacggccccatagtccattacttccgccagtccccgaacctccgactgttggtaaagtgggcgcaagtcagcagcatgtagcgttgccccgttatcatcaaagggaacacacggtaccgatgacggtagcataaaacagacatctagtggtgtttggcgcgcatcatcaattaggtactgaatgccagcaatacccgcaacattggcaagttcatgtggatcagtcgcaattgtcgtgacgccgtgctgtagtaagacttttcccaactcgctaggtgccaccatcgaactctccatatgcacatgtgcatcgatcatgccgggaacgatccactgaccggtcgcatcgacatgctgggccgctatgtacggctcgtcacgcaagttactaataatccggccgtgatcgatccacaaactggtggcttcaaattcacgggtataaacgtttaacacttgtgcaccagtaatcaccatttcaactgtcttcgtcatcgttattttctcctcactagtcagtctgcctacggagaaagcaaacgggtccacacggcaaattaagcagtgtagacccgtcgactcaattcgcttatagtccagtgtttacggcactgggtagaaactcgccatccatatcatggcattatataggcaattagttgtattgataaattgttccttactttaccagccttttcagttacatgcaagccctaattatcataaatgattggtacaatgaacttagaactagacatgaatattcacctaaatcaatgtcgggtctgccacaagcagcgctggcattttaaatgaacggcatacgatttgcgacaaggtcccttactggtgacgccatctaaccagaatgctgattaggatgttgttctgcgtacattgaaacgcaacatgttccgataatggcaagcccgtgaataaaaccgtcggccgttaagtcgtcttttataatgatttgcgagcagtcgcctttgatttaaagcggacccgctacgattaatcaacagtcatatttttaaacattcttttgctgactataagttcatttacgtttacaataaagctaaattaatattaatatacataactattttttaggagctgatgattttgatgatgatgaataatccgaccatgctctcatacattcgtcgggaacagccagtactagagcggttgttaaccaattatcccaaacagattacggcggccttgactgccacccctgatcatccacaacactggttgatcctcgcaactggttcaagactcaacgccgccaacaccgcccgcttatacatgcaaaagacggccgccctccaagtgaccattgctgcggccgacctctacgtcacttatgaggaagctgatcccagtgtcgatgttgttatcgggatttctctaaaagatgatgatccaaccatgcaagcggcaatcgaaaaagcccacacggccagtcaagctcatgtcattatcgtgactaatcaaaaatcgactgctctgaccgcaatggccgatgcaacttgtgacttactaactggcaaagaatcagtgccctatattacactaagctttcaagccatcgtgctcactttaatgttgcttgccgtccgcagtgctgcccttcaagcacggttaaccgacttagcagtcaatcaagaattagacgagttcagttttctgattgaaagcatgaatccaactgttcaacgggcgaacgacttctaccgtaagttcactattgatttcactaacgcccctcaatttacagctatcggtgctaacgtcctagctggaacactaactgaaatgcaagccaaattcaccgaaatcctccgggtaccaacgcatggttactcattagcctcatttacccacggtggctttatggggacgcatgaagatcactgtcagttctatcttgaaatcaatacagacccggctgtcatgacccaattacaggccgtcaagacgtacgaatcgcgattaacgccccacatttataccatcagtctcactggtgaccaaccgaccgtcaatgatgatcaaaccctccagctcgaagccgttgctgatccgtataaagccccactacttgcgattatcccgttccaagtcttagcttggttcattgccaaatcacgcgggatcaatttgaaccatcccatgtacgcagattttcaagcggctactaaactcaagtaaagattactaaatcaacgcaaaatgaccagtatcgatattcttcgatactggtcattttaattaatgttcgttttccgtaactgcgtaataccgaattctcttatgttgacgctgtgcatagccaatttcttgcctagtccgctcaccaatgtagccagcgacattaatgactactacttcatctgccaagtcgatttttttcaaatgtgtctggcgtaaattctgaagctcaatcggtgttaatacttcatcactgaaagctggctttaaaacaataacaccttgtttactcagagccagctcaaccgcttcaaatactgccgcatattttctagacccacataaagtaactattttaacagccattcgtcaaccttccctaaagtgaactgatcgaccaacgattaaacctccgttgcagtcacatgcttagttttcactgcagttcgctgattcaagtgcgccataccaacaccagtgaaaccgctgattaccgagataactggacaaagtaaactgaagaaaacaaatggtaagtattggacggttggtactcccagcgtcgtcgtcaggaagacgccgccaacgccccacgggactaggtaattgatcaccgtaccgccatcttcaaggacccgccccagtgcatttccggataagccaccatcattgaatgcctggcgaaaagcgcgccctggtaagataatcgaaagaaattgttcaccaacaaacacgttgacaccaatacaagttaatacacccgccaatactaacttgccatcgctattcaagtgcttagcaaccggggtcataatttgattgatcagtccaaacttgaccaataatcctcctaaggatagcgtaaccacaattaacgctaccatactcatcatgctgacgattccgccccgtgaaagcaacgtatcaacactcgtattccccgtcttcgaaacaaatcccgtgttaataatggcggttaacttcgtcattgatagcccaggctgttcaaatagaatcaggcccgccgaaataaaaatatttaaaagcatcgttggaatggctggcattttaaacccggcacaaatgaagactaagacgattggtaataatgccaaggctgagatactgaaatgaccatttaaaaccgcaactgtttgattgatcttggctaagcttgtctccgtattactgtgccccagcatagcaaacaagcctaatgaaatgagcccggccggtagcgtgctccataagatatgcttaatgtgcgtaaaaagatcagtatccactacggctgaagctaaattattggtttctgataatggtgataatttatcgccgaagattccaccactgataattgcaccggcaactaaggctggattcagattcatggtcacgcccatgccgaaaaaggcaattccgaccgtcgatgttaccgtaaaggcactgccgaccgccgcaccgactagggtacaaacaataaagactgatggcaaaagccactgaatattaatgattttgaatccaatcaccatgagtgtgggaatcgttcccgccgcaatccaagttgaaatcatcgcaccaatgagaataaagatgaagattggcacgattcctttatcaatgccctctttaatcccggcattaactgctgaccatggaaaaccgcgcaacatcgcccaagcagtgacaacgcccattgcgagtaatacgggaacttggggcgataatccccaaccaatcacacccgcactcataattccgaggacgaccagtaagacaatgactgcttctaaggtactaatttgtggtgcttttgttttgttcataatttattaccccttcgattgataaaattccagtgacgcatattcatcattaaaattttaatatcgtgcaatcccaccacagcgttgatttgtcattattctcatcctcttcatcaaaaaaaaaatcgtccccattgttcatatgaacaacagggacgattagactagtcgcggtaccacccaggttgcggattattgacacttaatccaccactcactagaagataacggttctagttattatccgttcagtcgaaactcggttaccgtatttcaatcatagtagctgaccggttcgcagcaaccaccggcttcctgacacctaccactatgtctacttgatgtaacgttatcgtacagttattaacttgtgattaacaataccaccatcttttatcatcgtcaagccattttataatataattctcattttaaggttacgaccgcgttacagctcgcaagcgcgcttggtgggcaaaagtgatgccaccaaatagtaacgtccaaataatcgcaccgattgcaccgacaatatcagcttgaatgaagaatagactggcaaaaataagaacaaaaaaggcaatcgtcagtgggctcgtgattcggtacgccggcatcttaaacccatccgccagatagtcattagatagccggtacttccgatgggccagcatcgccagcgtgtaaacaatcaggtacatatcactagagatcccggtcacgacggtaaaaactgccgtcgttgcagcacttaaactcatgatgggggtcactagcactagtatcgcggacaacacgattgctgctgccggcacaccacttttcgaaatctgatcaaagatttggtgcatgcgactcgtaactggcatttcagtggctagctgatagaagtgacgtccagctgagaacaaacaactatttagcgatgaggctgccgacgttaagacgacaaagttaatgatggcggccgctgctgggtaccctgccaacttgaagacttgcacaaacggactgctatcgggtgacagtgacgtccacggaataatgcccataatgacaattaacgcaccaatataaaacaacaaaatccgcaacaaagtttcattgaccgcctttttgataacgcggtgagggttcttggcctcaccaatcgttatactgacaaattcaatgccctgaaaagcaaagaagaccattggaaatgccgagataaaattagctatcccattgggaaagacctgataattatggaacaaattgccgattgaagcctggcctaatggggttgggtgatgtcccaccatcatgaaaataccagtgataatcagtacaacgattgcgacgatcttaatcatcgcaaaccagaactctgcttcgccaaataaccgtgcagccgttaaattaacgcccgccaaaattaacaggaagctaatctcaattagccaggcggggacatttggtaaccaaaatttgacatacgttgccgtagccgtcagctcagccatacagacaaaaatcaaaccgatccaataggtccaccctgtaaaatgaccaacactcggtcccaaatagcgggaaataaacgccacgaatgtgtgttgggtaggatcagaatagaacatctcaccaattgcccgcatcattaaaaagaagaagaagcccaacaccaagtacacccacatgactgacggtcccgtctttgaaatcgtactccctgaaccaagaaataatcctgtcccaatcgtgccaccaattgcaatcatttggacatgccggttactaagtgcccggatcgtgccatcagcattagttattttcataagatccctccacaaattttaatgactttgttgttaaatcttaatgttgtgtcattatagcacgctctagctttcacttaattgcgatttttaactgttaacccctgtttttaacgacgaatagatcgcaatactttgttttctaaagctgtcctccttattgaaagcgtcaccaaagctgtagttgctgcgtttgaccgcctaatttggcgctacgaaaaaagccgcccgagtatttacccgaacgacctcatttatttaatgcacccatcctgacacaataacacttaccacaaaaaggcaatcatcttgtgagcgacacttggattctgattcaacgcgcaatgcgccgcctgttccccactgtagaaagcttcttgatactgtgttaattttccgcgcaacaagtaccgaattgagcgcgctgaagcgacacccacaaaaccatcattgttataccccgtgtttgtatctccatagacattgagtagtttcacgttgtctggaaaattgtggcgatacttgagcatttctgaaaaatgcttcgtgaaacgacttggtttaacatccaagcgccggaccgttgcttccgtctgcgtgctcagaaacccggtcaggccatcgaacggtccgccaatcgtcacgattttattcaacgttggtaagcgtttgtcatgcccatacttcaatgcctgattgacaatatcattggccccgagggaatgaccaaccgcattataagctttgacgccatacttcgcttttagtttggactaagacttggtgtaaccaataaatctgggctttttgtgaagcgtgattatcttgaaaaacaacttgaaccatcggattcttgattgacttttgccaataacccttaaaggccatcacaccattcttgtacacgtgcaccactaacgctttttgggcagcccccgctttttcggctttacgaatcagatagttcgtcgaatacgccccaccattgtagccatgtaaaaagaccgtcgctgtctttgactggtcatattgattctttaatattcgtgcagaacgcggtgtcaattgactcgttactttcgtaatcttggtatcatgattccgggccccaactaaaatcacagccgcaccgataacaaaaacaatcaataacaattgaatcaccgttcgccaacgtttcatcaaaattatcttacccttcattatgtttaacagtcttattttacgcgtttcaattaaaataaccagtcatcgttttcaacaatcgcctttttaacccgcaccaacgaatattgaacccaaatcatattctttagccccccatctcgttataatggacttactaggttaaataactaacctactcaaattgtttatttctggagggtaactatggaaaaaccaacgtttaaatatcctgataaggctgcgtatgagttcgtcattcaagccttagcctcaaaagggattacttatcatgaaattgcgcatatcacttataacttacaaacaaaatacgtccctaacttaacgatcgaagagtgcgaaatggagacgcaagaagtactgcacaagcgcgaactattgaacaatgcgatggttgcgttagaactcgaccgacttgccacagaaggccagctaaacgagccgctccaatctatcattgccagtgacgccggcgtcttcggtgttgatgaaggcttagcacttaatatggcgaatatttacggcaccatcggcgtcactaattatggttacgtggataaagttaaagaaggcgtcattaagaagttagatactgataagtcaggcgttgttaacacgtttattgatgacctagttggtgcgattgcggcggccgttgcggctaaaattgcacataagtatgcctaagcattgtatttgctagtcgttatcgcttataaaaatcagcagacatcctacttcaatgcctgtttgcttgaattagctagtctgtactggatatgtccgctaaaaaacagttacttcaaaatgaggtaactgtttttttgttgaccatgctcaccactaaattaacccacaactgccaaatgacatgcctactcctcgacctaactactgtaactgatctgcataatctcgtaagtaagttgtcatcgtatgcggggcgtgactcagcactttttcagccgtatcggtcacgcgtttagcattgcccaactgggtaatcaaatacagcattaccataacattaacatagtccttcttgattccccgcttcaacatcacgcggcgaaaccgccataagctcggtcgatgatacgttaccgggtgaccacaggattcagtcattagcgccgcaatttgctgataagtcaacgcttctggaccagtcacagtcaatttctgttgtaaatattgtgtatctagtaacgccacgcccgcaatctcaccaatatcacgtgtatcaataaaactcgtcttcgaccgcccggctgggataaacaaatcgtgattttgctgaatgtcgacgcgatgcgtggtattcaaattttgcataaagaagctcggtcgaatgaatgtgtacggtaactgtaactgttcgatcatctgctcgatttgatgatgtggcgtcattggattatgctcaacacccatcaacgaaacaaatacgacctgctcaatgtggtgtgcttgtaagcattttaggaagggccacatatcttgcttgggtttagcaagttgtggtggccgcacgaaaaaaaccttttggattccccgtaacgccgcatcaaaggtcgtctcgtccaaaaaatcaaagcgtcgaatttcaacatccgaatacgcagccaatagttgctcgtctttatgcaaattgtgggcaccagcaacaacttgcacccccacctgttgatctagatattgaattaacggtaagccaatatttcccgtcccacctatcaccagtattttcattttattaattgctccctagtttttttaacagttgtcttaaagactgtttttcagcagccgtcaatttctgaagccccgtcgcaacgacctgatcgctaatacgctgaccggcctgcaattcttgtatgccaacttgggtcaagcgtagtagctttgctcgctgatccgctggattaacgtcctgttcaaccaattgcttggcagctaagcgtcgaagaattcctgacatcgtcggccggtccatatcgagaacgtggcacagctggttggcagtcggctgttgcgccgttctttcgacccaaagactgatttgttgcatcacagcccattgttgaatcgtcaatccgttagcaattagccgttgatttagctgataacgtaactgtttggaaaactgcattagtaaataaccaatattatccatttcatcctccgctatttagttagtatactaactaaatagctataatttgtcaatttacacacaaagcagtaccgcttaactgtgtcaatcagtttacgctggcaagtaagtagtactgttttataatgtttcgccccaaaaacacggcatcaactcataagccgatcattttaagccatctgatgttctgacattgcttgcatcttgagtacgcgctgttcacgtggaataaacatccgaatctcatcttggttaaagccgcacagaagtcggtgatcgtcaaaaataattggccgccgcaataattgcggtgtttggcttaatacccgaacagcttcgcttaatggcatatcttcaatcggtgtcgtcttactcagttggtgataagcattggacttagtactgatcaaatcatcaatgccattgtacgtgtactgtagcaggtgcttgatttcagtctccgttaacggctgtgcattcatattacgttcatgaaacgggatccggtgttcgagtaaccaccggtgggccttgcgacaacttgcggtacttggtaacacacataagtttatcataaaattatccccaatcttgcttgcctaacaatgcagcccccattattgtgcactgtaatagttgacgtcatcaattaacaacataatcatagcaaaattcgcagctaattgctagcgttttcaaaaaataattaaaataatttgatgagcgcagtttattgcaggcctaatcccaatttcatctataccaatattacgcaatttatattaagcggttggtaattgaccactatccttcaggtaatcacgcagtaccactgcctgattatgttgttcgtccttggcaccgaacaataagatcacattcgtcttcgtcagttgttcagcaacttgactaataaagctggccgtcaggggattctcatccaattcagcccggtaacgatcgacaaattcgggatatttcgccggttcatgattgaaccacttacgtaacgtggtcgacgggccaatttcctttacccaattgtccaactgagcgttaaccttcgaaataccccggggccacaagcgatctaccaacacccgataaccatccgtatcaactggtttcgtgtaaatccgttctaattttaattgcataatgagcactcctcctatcgtacgatgcggtaaacaatctatgaccatttacaataacctatcacatttcatgaccataagttgactccattataacgcaggtgccggtatcgttaaatcgaaccaacactttcccgcaaccacatattgatcagtcctcgtgacagccactatcatcaattcagcacaaaaaaatcaggtcccacgaatggccctgattttcatcacaatgagttgactaacatcttatcatgattatgacaatcacgttagccttcaccgatcacaacttcaacttggccccttttcggcacaaaattaatgttataaatcggttcccgcaataccttttcatattcttctaagacatcttgtggcaatggcgtatgggcggccaatgcgcgcattaagtcatcgaccgaataaacatcttccatgttaataaagatccgcatatttcccacaacatcattcaataattctgtcaaaatcgcattgggcttaccgttaccatctgtaacaaccacttgattactgtcgacttctttatggtctatctttgttaacttaacgatatcaaatacatttaacatgcgcgaccctccgtcacaatattgatttgctatattctaccacaaccatagcacatctgaagggtgaaaagtatttaatgttgactgaattaatcaattgaatagcgtgcaaaaattttttcttgaaccttaggcattggaagtttctgccgctcaatcaacgtaaaggtctgaccagcaaagtaggctaagtcacttaacccaacttgaccactcaaaccttgaatggtccacttctgatgcgtaaacgtatgggtcacaggccgcccggtcagataatgggccgttagctggagctgatattcacgtttaaaataattttctaccgccgtaactagttcttcaggttggtaatcatcatctaagtctaaatctgcaatcggaatcaagggaaccgtccataaattagccaacatcccgttactcggtcgcttcgtcatcaaccactgatcctgcatcttagctaataccgccacgtaagcaaccggcttgggccgcggtttcttcgtcttgaccggataggctaactcatccccatccaaataagcttgattaaagcgtttgaccggcgaatgagccgtatctggttgccgcgctgtcatgtagcttgaaccgaggtccataatcgcctggttaaaatctccaggtcgctcttgtgaaataatctgactgattacccgttcaaaaacagcgcgggtctggggcttcgcaatatccgcgtcaatcttgagcaaccggctaaagacgcgataggcattaccatccacagctggaactggttcattgaacgcaatgctggcaatcgctcctgcagtgtacgggccaatcccaatcaactccgtcagctcagcggcagtttgaggccactgtccatcgtaatcggttaacaattgtttggcacaccgttgcatattgcggacacgtgaataataacccaggccctcccacgcctttaacaactgtgactcaggtgcggcagctaggtccgctaccgttggaaaaagtgccataaagcgctgataataaggaatcacagtttgaacctgcgtctgctgtaacataatttcagagacccagacgtggtaaggctcatggtcatgtcgccatggtaaatcgcggccttcgtgatcaaaccaatctaatagcgtcgtctgaaaatctttaattgttgccgcatcccattcaatcattactaaccctccaaaaaaggccacgaggcttcgtctatccgaagttcgtgaccaccttatttacaaattaatccaaagtgttagccaaatctacgagtgttttttcgtagtgatccgtcacactttcatcctggaaatcggcattgaaaacggccaatgtcaaatactcggggtattttaagatgaccgctgctagccgcttattaatatctggatatttttgatcttcattattcaaaatatccagactcgcttggtaacaaacattggctaaaaacaaataatccacaaaataattaaatcctggttcgttttttaattcaaaatgcgccttcacgtccactgtttccgaaatattcgttaaatacttcgttacaatttcttgatactgacgtaacaactccgcctttgcttctgcatgtaccgttgccataaaatatccccacctaatttaatctctgtgaagattatagcatacggcgtaacccctgctgaatgttagctgctaatccagctaactgatcgtactgccactgacgctcggcagtgaccgcaaccatgtcatttggttgcgttaaattaaccaatttaattgcttggtccgaggcccgcagcgcattttcatccgcatctgcggaagctacggcccagcgaacgcagtccagtgccgccgcaccaatggaactcgtcgtcgttgcacttaacttagtcaatcgtgccagtgcctgccgtacctggtagccactaacaagattaacttgccacaattcattagcatcaattgcgagtcgcaattgtcgatcatatttctgttggttatcaacatactgcaaggctttcttggcgataattaacgcccatttagccaattgttgttgtgagagttcaccagtcaaagcttcgatttgagcccgtattccaggatcatcgtcaatctcaatcttagggtgactcggtctaaaaccttccgtcatcacgcattcctactttcttacaaatccgacaacaaacatatcctatcattatcaatattcagttcaattgatatatcgataggattaaattgtaccagaaatccagcaaagatgtgagtatctgactccagatttcatcaaaaatttacaaatttttgtaaccgtttcatccactataaatacaataaaaagacgccctgccaccaatcgcggcaagtcgtcatataaaccattactgaatttcaatatgatgggtatccgcagctgccttctttggcaaagttaactgcaacaccccattttcatatcgtgcttcgatcttgtcaacatcaacgtcgggtaaagaatactgccggccaaagcgaccagtttgacgttcgctcgcgataatattaccatctttatcgctttcatcactaatactatcgcgttttacagcaatcgataatgtgccatcccgatacttcaaggcaatattctgtttatcgattccaggaacatcgactttcatcgtgtactgatcgtcattttctttaatatcagtctttaggaccgacccatgactaccagcatttaagaatgtccgaccgaatccattaaccaaatcgtccatcttagtccagtcattcaaccgatcaaataaatcattgtgccaattcatcatatcgttagccattatgaaatcaccctttcaatttgtttacatcattaataataagcactttcatcaagattgcaacaatttagcactctccgtattagagtgctaaatcactccacttgatatgcccgcatatcaactgggatcaccctgaccattttatgtggcgtgattgttagttgctgggtcgttatcttcgtaggccagcgagactgcgggcgatcagctaattccaaaccgaccaacattctgattcgatccagaatatcaggcaccccaaatacattattaccctgattaaatgaagtttggagcatattaatggcaacctgtaagcgctgattatggaagctaaaggttactggcacgtacaccagatcagtagacgataattgctcttgtgccaacgtcttatcaagctgcgccataaacactgtaaattgatccatttgcgtcacccccatcattaattaccgctattatactgcaagactgctgtgacagctattcaaatggatggctgtcatagcactgctaacaaccgaccatcagtctccgtgccaactgcaattttgctcgaaccagtcaatcatcaccaggcgatcccgtgcactcattttggacaaaataaaagggcgcgaccaatgtctcgccctaactgaagaatcacgctaattattagttattagataactttttagcatcttcatcgatcgtttcgaaaccggaaacgccactcttcttctttggatgctttgcacgttcttcttcggctttttgaatcatagcctttttttgttccttgctaagcttttgtgccatgattatcgcctcttttatcttggacagcgaagtacaacttcgctacatgttcattataagtctaaattcaaaaagtggcacaaatttgcttaacttttttgaaactgcttacttgaattctgtaataattaagtttacagttaatatgttcaggaggggattatatgacaaatgtattgatcttaggggctgcgggccaaattgctcgtttagccgaacagcaatttttagccaacacaactgataatttgacactttacttacgtaatagtagccgggtcgcagaccaacaatctgaccgggtgacgattatcgatggtgatacgactgatgaagccaaattaacccaggcgatgacgggacaagatgtcgtttatgctaatttggctggtcaaaacatcaaacagcaggctgaaacagtgttaaaagccatgcataccagcggcctcaaacggctcatttggatctcaactttagggatctatgacgaagttcccggcaagttcggtcaatggaacaacgcaacgttgggtagctacctgacgcgctactacgccgcggctgaagtcctagaaaattccgatctcgactacacaatcattcgccctgcgtggttgactaataaggacgaaatcgactacgaaataacccagcgacacgatccgtttaagggaactgaagtttctcgtaagagcattgcggcactcgtcgttaaattaacccaagatcccacaagtaacattcgcacgtctttaggtgttaacaaacctaataccgatggtgacaaacctgcttggtattaattaattaccaggccgtcaaaaaaacaatttaaagatcaaccagaatcaccacaataggcagtgcgtggtggttcttttattatccatcaaattatgagaaaaatgataatatctagacagttaactaacgatgactgataatcaagctatcaattcactggtataaccagcaatccgttctcatgtttttttcatcaaaagtaatacctgtaaccattgataaatcgcgggtctttgcaattgacggtcaaaaatacaagtgttaaattatagactcaatttgaaaataactggcgatattcttcagttttcaaggaggctttcacttgaatttgaaatggtacgttaagcaatttaatggtctaaccaccacccaactgcacgatatttatcaacttcgtgccaagacctttattaaagaacaagatcggtcttaccaagaccctgatgatactgacttggacgcgcgtcacgtcttcgcctacgatcaggggcaactcgtcgcttatgcacgaatttacgaacatgctggggtcgtttcgttcggccggataacgactgacagttgctatcgtgggacgggccttggcaagcaactcatgaatcacgtcatggcaattcttaaagtgcattacagcgccgccaccattgaaatcgatgcccaaacgcacgcccagaagttttacgagaagttcggattgattgcggaaggtcagccttatattgacctgggtgccgaagttattaaaatgcacgcccccgcccggaaactggtgttggcgtagcacaacttaccaaccatcgtcccccaagataactttaatctactcaaattatgattaaagctgcgcatcagaatgttaaaattctgacacgcagcttttatttttggtcatttcacaaatggtcaagtcctgctgagcccttattcaagggccctcactaaacaaaaatgataactatcattacaactaatcactagccggatcactccgatactgctgcaagatataaatcgcgacaatcaccaataacgagccgaggatttcgacccatgtcacttgtaagcctaagaaaataatacttagtacaaaagtcactactggttggacggcatcaacaatactgaccaccgcagacggcgcgtactgtagactatgtagcaacgataagaaagcaaaaatcgtcccgattaaaacgatggcgccaattgaagtcactagcgttggtgtaatttttggtgcaccgatccaaattgggtgatataaattaaataggattcccgcaatcaatgtcccccaaccaagaatcacgaccggtgaattttcggctacaatctttcgcggcaagactacgtacaaggccgctgttacccccgaaaggattccccagacgagtgcatccatcggaatcgccaactcatgaatattacccttagtgattgctaaaaacacccccaacaaggagaccgcaaacgcaattaaatcagtccgtaaaggcagttcccgtttaaacagcaacgttcctagtacaataaacaaaggacttaagtattgtaaaatagtggcggcagcggctgttccgcgctcaatactgatgtaaaaagtatacatattcgccatcaatcccactgtcgcgtatgccactaattgtccaaccgacgcccaagatctaaagactttgaagatgttggtaccctgttgcacaaatccaatcgctaacagaatgattccagcagataacgtccttacagataagaaccaatcagccgggatggcttggttttgtgatacgaactgcatcactgtacctgagactccccacagggtcgaggccaacatcgcccacatgatgcccttcatataacggttagttgtcatatttttcaatttcgctctacctcaatttaattaatggcaatattataccgagacttaattaaaactcactgaaaatcgagcgttgttttttaggaagattcagtaatctttatcataatcaagttctatcatctataagcaacgataaatccgaacttttattactaattgtgcgcaattacacggaaaccgccctcaactaaatagcactggggcaggtaactacagtaattgcccgccccagtgctatttaagttcgtaccgatcctaacaatttgcgcccatactgatgccgtttccagcacaccgtacttcaagtgccgtttggttagctattgtttcactgttgacaatccctagtccgaactgaccaagacagaagtacttaaaagagcgtcccaacgtagtagtgaatgaacatcgtcacgatcccaacgagcacgttgcgaatcaccgccgtcttcacattgcccttacctaatacggccgataaatatcctgttaaggccacggcaacggacaccgcgataattgttgccggccactgccaatgagccggtgcaaacgtcatcgcgagcaacgggaagacgcctcctgctgacgctgagaatagcgatgcaaacgctgcatcccaaggattcatatagtgtcctagttgcatatcatatttgatgctgacaactgttgccaatggttttttagttaataaatcgcgtgcaatcgccatcgccgtctcttccgtcacgccaagagtcatatagtggcgttgaacagcatgcaattcaccctcaaaatccgtcttcagcaattgccgctccttttcaaccacggctttttcagtgtccttctgcgtgctgaccgaagcatattctcctgacgccatcgaaaaagcacaggctaataaatcagataatccagcaataaaaatcgtgaactgattagtcgtggcggccgccacactaaacagcacccccacaacggttaaaataccatcattagaacctaagacacctgctcgtaatgagtttaacttctcatccatcgtttgtttggtcttctcagactttgtccttgtcagttgcataagctcgctccccttgaccctttaattaagcaaataagtgaccaataaagtacgttacgatcatcgtcaataacccggcaacgacgttacgaaccattccgcgccgacgattagcattacccagcatcgccgcaacgtatcccgtaatcattaatgcaattccgacagccaacaccgttgctaacaccttcacccgtggtgggaaaaaggtgatcgaaactaatggcaaaattgagccagtgggaaaggcaatcatcgacgcaataccagccgcatacggactgatgaactggttcggattgaaaccatagcgttcacgcaccgtcgtagtcagcgcatcttccgccatcatttcccgggttgcttgttgcgccaacggtttactgattccttgatcgacatatttttgtacgactagcgacgcttctgcttcataatcatcggcaagtgctgccttctgcttagtaatcgccattttttgtgaatctttttgcgtattcacggagacgtattcacccatggccattgaaatcgtcccagccaacatcccggctagtccagatattaaaatcgaaaaactattggtggttgcccccgcaacgccaacaacaatgccggcaactgatagaattccatcattcgctcccatgacacttgctcgcaaaatattaacccgctgtgccaaagacattctttttttcatgtttgccgcctccgtagatactttataatcattattacctagtaaatattatatctttcagaaagaaaatgcaaggcttatttgtaatcattatcgagtataagttatgtatccctaaactatagtatagtgtaccaccatttaattattaaagttaatttgaataattattataggtcattgaaagtgctattctgcctagaatcaaaaaaagcagcaccgttagcataaaatgctaacggtgctgctttcatattttgaccctaatatattccaacttagtttgctaaccggaactgttgggttgtctttaattcaaattcagtcggttgcgcggccgtcattaaagctggtgtcaattcgacccgcgtaatcgtctgatccgcgtatggttgcatgtaaaatgctggttcattcatgctcatataggcgcggtactgggtataatctggcgtcccgttatcttgcatcttaacgcccttaggaatctccactgagttcagcatgtgtgataatgcgttgacagcttctgcatcagtcgttactgcatccgtatgttcacgcatgaagaccgtccgaacgaagcgtgcaactgacgtatagtcaccaggcattcccaacgccccagttccaggaccgaaaggattcaccgtcatgtcaccgtattgacggctaggatgagggccgggttgtaagttgacgtaattactcaaattcttgagatgccattcaaaatctggtgtgttcgtcatgacgcccaccggattcttcatgtagtgaacaccgtcattttccaattctaagacgtaagtagaaccactcttgtcactaatgatccagtgtagtggtaccacaatattcaatagtggtgcggcggcttccatcacgttcaagtcagcaatccgttcgcctaattcagcggtgctcttcacgtttcctaaaatccacattaaaacttcgtggggtgccaagttaaccttgccagccttagtctgctgagtaaagtgagcttgtcccgagaaatagagtgcagcagcactgaccccgtgctcattgacaccatcgacaaagatatagccatttaagtcacggcccgttccaacaaagctatacgggctatcaaaaccgtccgcattggtaacactgtcaaagtggtgattccgtgggattgccactggtcgaccaccaagttcaaaagcaaagtccatggtgcgtgctaaaaactgatcacccgccgtggtttgaatcgttaaactagtacacatgggtttcacatccttgatttaaatactattattctagcatctaaacccattataaacacacatttgcacaaattaatttacgccaatcagtttaccttagtcttttaatcgtaacgtcatcgcattaattgccacgattaccgtgcttaatgacatcactaccgcaccaaacatcgggttcaaaataaagccgagtggtgcgagaataccagcagccaaggggattgtgatgacattgtatccagcaccccaccataaattttgcgccatcttccgggtcgttcgccgggccagagccaagaaatcgaccacatcatttggattactcttaacgagaacgatatcagcagaatcaatagcaacgtcagtcccagacccaatggcaacgccaatatctgcccgggccagactaggggcatcgttaacaccatcgccaatcatcataacgtggctaccatcagcctgatactgttgaacgagcttagccttatcttcgggcaataaacccgcatgcacttctgtaattccgagctgcttagcaacgacttgggcgctctgcggattatcaccggttagcattactggggtaatgttttgggccttcaaactatcgatcaagttcttggcttccggcttgatctggtcaccctgagcgacaaaacctaagactgtctgctcctgaatcaaaaaactgactgagttaccggcacttgccagtcgattgaacgtttgctggtcataggctaaattttgtttatccaagtaagctgccgaaacgatctgatacgtctgcccatcaatcgtgccgcttaacccgacaccagtaatctgatgaacatcctgactaaccttaggggttaactgatgttccttagcggcagcaagaattccgacagctaagggatgactagagccattttccaaaccggccatcatcgccaagactgcgtccgcagttagccggtcggcgatactttgataatcagcgaccttaaagttaccagctgtcaatgtcccggtcttatccatcaacgcgtagttcaactttttgacttgttccatcgcatcccgattacgaatcagtaacccgtggctggccgcaatcgccgtactccgtgccactaccaatggaattgccaatcctaaagcgtgaggacaagcaatcacgagcactgtcaccgcaattgatagtgctaacgccagattgcccacgagtaaccagacgataaaggcaacgattgcaacggtcaaggcagcgtagaacaagagtccggccactttatccgccatattttcttgcgacgatttggccgcctgtgcgtcactgactaacttcatgacttgggctaagtatccggattcaccagtcccggtgactttcatctcaaacgtcccatcaccattgactgaaccacccacaacttgatccttagcgcgtttttcaactaacttagcttcaccagtaaccatcgcttcattcacactagtcgcaccatttaacactgtgccgtcagctggaatttgttcaccagcccggacctgaacttgatcaccattagctagatcagcaattgccacgtcatggacctgcccatcaactaacttatgtgccgtacttggtaacagttttgctagtttatctaccgccgatcccgcattcatgaccgtattcatctcgatccagtggcctaacaacatgatgacgatcaaagtcgctagttcccagaagaaatcggtcaccattggttttgcatttaacaagtcattggcaaccacagcatagatactgtaaacgtacgccacactgatacccattgtaatcaacgtcatcatggcaggcttatgatttttgacctccgccttggcaccgctgaaaaacggttgcccaccgtatagaaacaggattgtgcctaaaattgcgacgatataatcggaccatggccgaaaaacgatttgaaatggtaaattgacccccatcatcggactcataatgataatcggaatcgtcagaactaacgctacccaaaacttcaacttgagattgcccatgtgcatcatctcaccgttacccatatccatatcgcccatgtcatttgaatcatggtgcgccatgtgttgcatatccatgtctttcataatagcgacctcccctagtcggattgtctacatctgtaatttatggctaaagtttacaattgtagacgataaaagtcaagaaaaacactttcttgactttttgtcgccattcatctgttttctgagtatcctatcttgaaagtaagtcccttccattaggcgcactataactgatggttccgattaaggcctgcacgaatgccccatgttcagttagccaagtatctttaagatcatttccctcaaaaaatgtcatgttcagattaagaaaatccaaacatgacattcagtgttatttcaatattcgtttataaccacattaacaccgcgtccccggcacacaatcgcagtccaccatttctggcgcatccttggctttttcagccaatactgcctgtaaagcggcgatatccgtttgactcaattccgtttggttaacaaggtccaccaacgtttgaccaacgcgcatctgacataaatgaccgaagagggtgcccacggcctcatccatcgatggctgttcctcaaccattggataataattgaacgctcgaccattcttttcagcacgtaacgcaccttttttgacgagccgtccaagcagtgtcttgaccgttgctgtcttccatcccatcttatccgccatgatctcagcgacctgactactcgtgacattgcccaacgtccaagcaacccgcatgacttcccattcggcatcactgatttcaattttagtttgtgcttccaatggtttgaccacccttcgaattaaattaactgtagtttacaaccgtaaacgtaaaaaagcaactatcactctcgcatggttcaccatctagcatagcgcaattttctttctaataacaacattgactgccattaaccactacccaaatcatcactagttaggttaataacttgattggcgcaaaaaaacggccctaattactgagccgcaacaaaatgatctaataatgatgataacgccgcgacgctatctggataattgctcggatgttgtaataggtaactcttgattttgccgtgatacaataccgtcgtggcggcctgtccgctcgtctgcaataaactccgccgaaattcattgagcaacagttgtaacccgctttgcgctgcgtcttggcgctccaacatcagtgccgcacggctgatagcatcgagaacctgcgtttgcgtgatttgtgattgtgttgacatgtttttccctctatttactgtaatatgcttaagtatacaccgttagtggcacaaacaggtattatttatctgttgaaaaactatgttatgctactaaatattaattattttagtgacgggggttcagcatttgaaaccaaactcaaaactattacagcgactacgatcatggatgcgtgggcggtacggtcaaaatgatacgttaaaccgctttttaaacaatctcgctttactattgatcgtcatcagttttttcattcgcaccgggtggctactcttaattgccgtgatgctcatcggtattagttactggcgtttgttctctaaaaagatttatcagcaagttgcgatcaatcgcggctttcagcgcttttggtcaccgattattcgcccattcagccgtttaaaataccaggtcaagcagcattggcaataccgctttttccgctgttcacagtgtcaccaacggattcggattccgcgtcatcatggtcgcgttcggataacttgcccccaatgtggacaccaattcgaagctaaagtgtaaccatcgtgcttggatgaaaacataacgattgttgaacataactgatccgcctgcagacctgattttgcttagcaaccacctataataggccaccttagtttgacactgaggtggcctatttacatacaaaaacactattttaacaaccattacgtgctacctttctcgctcaatgaaactgccgacaattgcagtcacagacgcactagttgagtgatggttttcaaactaccgtaaatcaatcctcttttttcagaaaaaacacttacgaaaaaaataattttctggtatgctaacccattgtattcaggaaagtgagtgtgaacaatataatggattcagtacaaagtagcccgcaagctaaacaacgggcccgcgttcccgttgcccatcccatgctagccatgatggggatgttaattggtggttttgttgggatgtttagtgaaacatcactgaacattgccctcccccaattgatggctcagctacacgtgtcaacggcaactgtgcaatggctagtaaccggttacatgcttatgattgggattgtccttccactttcaagcttaattaccaaatggtttacgacccgccaagtgattttatttgccctgattgacttcgccgttggtgcgattatttcggcttcagcgcctggctttggcgtgttattattcggtcgaatgattcaaggtatcgcaactggcctgatcttaccactcatgtttaccgtggctatgcagatttttccaccctacaaattaggggcagctatggggatggtcggtttagtcatcatgttcgcaccggccgtgggtccaacgattgctggagccatcttaggactagcttcatggcggtggattttttggctctttatcccattcttgattattgcctttatctttgccgtcacttcacttaaaaacattgcgaaagtaacccggccgaaagtggacttcttatccattttactttcaatggttggctttggtagccttgttgttggcgttagtcttgctagtgatcaaggttgggggtcgcccgctgtactaggtgccttaattttgggactggttattctggcttggtatgcccatcgacaactcaccatggaatcgccaattctgaaccttaagacatttgctatccctggttttcgggttggcgcttgcctcgttatgattaactttgggattatcttatcagccatgtatttactcccaatgtacattcaaaaggggctgttgattcccgttgccttgactggggtcatcatgttacccggtggcttgatgaacgcaattgtgtcggccgtctcgggtcgcttatatgactcgattggcgcccgcactccagcaatgctggggttcttgatttcaatggttggtgccctcatgttggcactgacaaccacgcagagtgcaacgtggtacgttattttggcccacgttatcttaatgattggggcgccattagcgatgtccccttcacagacgcatggtttaaattccttaacgggaccaattgccgccgatggtagtacaatcatgaacacactacagcaagtcgttggtgccatttcaaccgcgattgcaacgagcttattaggcattggccaagcttcttactacgccaatgggggtcatcaagctgctagcgcgttcgtcaacggtgcccattacgggttctactttacgtttattttagcgctcgccggtttgttgcttgcaacccgtttgtctaaaaaaacgactaactaactgtcattaatcaaaactagcgctgttaatcataagcagcctagtttttttattttacgatcgattatcattgaagtagtcttgggtggcttctcatcagcaagccacccaagactactcagtcaccatgcaatgcttagcgttcttaccatactaagaatcctgataaataattgcactttatcgcattttaatgcacaattaaaatgataatatgaggagtcgaaattaatttatggaattgacaattggtttaattattggcaccagcatcattcttgccatactgtgtggcatactcagtatttactactatcaccacaccaaaaagctgaacggtacgatctgggcactcattggtattgcgctattgtgcctggctggcttttttgtttgggtcgtctggtttgggttataaactaaactgcggctcaccgttactagtaaccaatccgaggaggaattgctcatgaacccagaagacatgtttcaacgttatctcaacaaatatcagattacgtatcaacatcctgaacatggtctagttatgctgacctcccctgtctggccccaacatcccgagctccagcaggccattcaaagcgcttttcaaggcctaaacggcgtcactagtattacaatcaatagtcccgaacaattagtcatgcgctatcactctgatcagttacggcggctaagtccgctgactttacttagcttagaacgccagttaagcaagcaatatcatcaagctggctattaaacttaatggaacgcaaaaatgcaggctacccggttaaaagtggatagtctgcatttttgcactttattattgatttagaatgttacagctgccattattttaccttcatcgccgctaaaatcgacaatgtggcgttttaagttagcagtccaagcttgacacccagccttggcaaactgcttgacagcgtctgttagagccagctggccagcaatatattgcttcgcgatttgttcaactgccgcggcatcttcttcacgagcgacccggactgctaagccattcgtccgccgttccacgagataaccgttctcaccaaagtaagttgtggcaccagtagcaacatcatattgaaaatgttgaacgcccaaatcggcttcttttttggcaatcgtggcaaagtctgcgtggtcacctaaattatttaatacgtcatcgatctcagttaatttaaacatcatgacacccctcgttctaatttcgtttacttatctattgtaatccaattagacacgtttggcaggtaacgggtagaaaattcgcattaaagccacgtaaatgaccccgataagcgccatgtcaatgaaggttgcaccagtcaccgtcgcaatccaagcaatgtgcttcaataacaagaagatggccacacctagtacccaacataatagcgcaatccaattcaccccatgatgataccaatactgccccttagagctcgccagttcgttgatatcatagtgctgacgatgccgccaatagtaatcgactaacatcacgctgatcatcggtccaagcaccatcccaatataatctaggaacgccgtgaatgcagctaaaaaactccccatgattaatggaatcagtgtgactaacgtggcaatgattgtcacggcccacagtgctggtcgtaaccgaatccgtgggaagatattcgacagcgccgaaccagccgccaataagtttaccgcgttcgccgtcatactcgttaagacaatcaccagtagtgctaatacccccaagcctagtcgactcgcaatggtactcgggtcagagttattaggatcataagttccagaagtaatcgcgatactgatcgtcgcggcaagcccgataaaggcgaaccagaacaagccggtaaaggcccctaaaaatggcatgccagtcgcgccactctttttgcgcgtaaaccgcgtaaaatcagcacccgctgtcacccaagacaaattgaacgccgctagcgtatccatcccagcccccgccgtcatatgtaaatgtgtcggcgcctgccacgttaacaaatcatgcactgagaccgtctggaacacgacgaccgtctcccataaaacaaataagatgacaagaataatacctaaacgttcaatcatctgaaccgaccgttgaccgaccgaaacactcaataaatgcaacacactcatgacaataattccgaggatcagtcctttagccccaccgggtttaccatagactggccagccaactagatcgtgtaataaatagctgacagaagttgctgcaatgaacgtgtttaccgctgtccagccaatatactgggtcaagttcacaaaggacggaacgtaactgccccgcacaccaaaggaaccacgaatcaagctcatcgtcgccgccccggtcttataccccatgaagccgactaacgataaacataaatacgatagcgtggacgatgctacaatcactttaagcgccgtcaataaaccacacgcagccaatacaccaccaacgtaccacgtgccattattggcattggcgccaatccaagttgcaaacatgtcccaattagacatgtgtcggtgcttaggcgccaccacttctatttgatactttgactcttgctgcacatcgttcaccctttctacaatgttttccattgtagtttttttagtgacgcttggtcaagtctatttagtttgaacagtgattttttaagaatgcttatatatcaacgataataggccgttttcaacaataaaaatagcttgtggtgcactttttggtgcattttatcttcaaaacacataaatttaccgattaatcatgctggcgggcaatacatataataagtgcggctgatgttttataaatttaagtattggtaaatttattgttaaccagatcaaacaattggcctacaactggcacaatagaattgaaaagacaaatttgttaggagtgatagcctttgaccactaaaagtattcatgttaaatttccgtcttacgaagacgctggcgttttactatttaagcatacacttagcactggcgaggtaataactggcaaagcacaatttgagtttgattttcttaatccacttcatccgcagattattatactaaattcaccgtttactcagctcaacggcacaaccattgaacttggtgaaataggcggacagtataccttgccaaatggtgacgttttaattgctaggtagctatcgcgtttctttagcttgtgattaaattttttgatagacttttgctaaggttggcatattacttggcgtaagcctgacctgttaatcattctataacatcagtcgtccttgattaattctaggatggcttttttgttgcgccgttatttacaaccgtaactccggttacacttgcaccctaacatttcctaacattttaggatcggtacaacaggcgtactctctgtacggttgttaataaaataacaatgctatggctatgataacagggttcaatggcattgctatatcagtgtttacgattaatccaaaacacgctaaagctccagttttctctaacttatttgtgttgattgattaactgcaaccattcacgcatagcttgcttgcggatgacataatattgcgacttacttagtcccgatagttcataggccacccgttggctaccatccgccactacgaactcattacgcaatagattggcttgacgttcatcacggatgctatcaattgcattagtaacccgctgacaatacaactccatttgttgcaatcgcctgggcttctctgcccctttccaatcattaactacctgctcaacaatcccatggtaaaaacggtactgctttaaatattggcgcgcgttacgataccactgttccatgctttcgctccctaaaagactaaaaagcgccagcgtttacagctgacgttttctagccctactccttaaacccatcataccacttgctaatcatcaaaaaagggacgctagccaccccgcaaacatccctttttacgtatctgacatttctgactatactacgactaattcccacaaagttaattatagcacgtctgactgtccgaacagctgtctgcattatatgcacacaaataacccaaccagtaacccaaccagtaacccaaccggtagtcaaacgccatctaagccagctgacatactcatccgtttttaatttctaacattttctaacattttgtttattcaaaacagctctaagaccagtcataacaagcattcaagctattaactaactagcgatgttcaatttccagtattttccagtaaaaaagtccaacataaaccaacatttcacgagttatcattagccgataagtattgatataacagcactcggaccaaatataccgtctaactgtgtcgggttacttgtcgcttattatatggtgtccgatttgtccgactaattcattacccgtccattttttagggcgtcagaaatgtcaggatagctatattaaatatgcaagttttcaagcgtcactatatttccaatgttaagttttgttaagtagcaatcaaattaggccatgacgtgtttaacgcaattaacatgcaaaacaatgtcatgttttgtcaagttgtaaacgggcttaatcaattgtagcaatcaccatcaacgaagccccgatcaatagctgtctgtgttggctcgccattctcatcaattatcccgtcattaaccatcttactgtatatctctgacttaacagcgttaggtgcattcttaacggctggttcagccttagcaatgtaattataggcttcttcaactaacttagggtaaagcactcgcatactagttcgcctccttatcgtggcttacttgtgcgtctaggcgttttatctctggtcttagggcttgctcccagccattcaagtcagcttgttctatggctctaatacgcgcattcatcgtggttacttggttcttaaacgaagtgaccccgatatttaattcggcttcatccgttgcaataaacattcccgtattacgaccgctccggttagcgacaattggcacgccgtgttgattaattaagatactaatggcttctctgacatcccgttctttaagcccggttaccttgcagatattcggtgttgtcattgggtaacccgcaccacgaggcaacatgtttaatactttaaattcagtcattgataacgtcattttaatggcacctaccttttcttatttgacggatgaactcaatacacccagattagacatcgtacactcgtaacagtgccgttgagtattcaacatcgcggccatcactattaatccggttctcattggtgtaactgacgacttcaaaatccataccattctttgctaattgctttagctggtcactcaaccggcaaggagctggtaaggaatcattaccgtctagccattggtcttctactaattcataatgctggggcttagctcgttccataatcacagttaccacgtactcattgtttaaatactgggtttgaatactgttaacttgataatctttgccttgtttgtctgtatgtgcttggttaattaattgatccaagtcttggccatgaagcactgtccaaattcgctcttttttcatttttaaattcctccgtcattcatttttaaatgcaattctttaaagtttatttcaaatttactgtcacactgtcacaatcgctataagcaccgccatagcaacgtttctgctgtcacaacgctgtcacatcactgtcatttactgtcacacctttagcttagactgtgacagtgtgtgacagcttgtgacagtaatgtgacagtaaattttgtttaaaaaggcttctatatcaacgtttaaaagactttgtgacagtgtgacagtaaattccacaaaaagtttgtgttaaaggattcgatgatagccacgaacctgctttccatttaatcgcaagcgtccatattcccacccttctaaattatccaacaacaacttaacgcgtttagaattgctattagttcgcacggccaaataatcatctacttgttgattaaagacaactgacaatatctctcgtactgaggtttgctgtagtggctcacgttccttacttaattgactttcaatttcgttagataaccgcatactattaactaagtcacgatagtaggtatgctttacacttacagataacttgtcccaattagtcggcactagcatttctaaataatcgttaacagcgtctctcatgggatcaatgacttgggcttcttgttggtaggctttggcctcattaagtgtctgttggtcaaaataaagctgctcgccagcatcaaaccaagtcttagcttcggcaaggatttgtagcatgtcagcttgttgcgcctttagtgggttcttagtaacgggctgtactccgcatttaattggataaaagcgccgttcaccagtggcgtcttttaaatagtctcgatggttggttgaaccgataaagacattccggcgcggatgttgttctggccggcgtgcataagtgttgcggtaatagtccgactgggcgctagtaaagttcttaatgctctcaatatcagtcttgttcatggccgacagttcagcaagttcaataatccaactacccattagcttttgatagtcgtctttgtctttcatgctcttcatgtcatcgctaaagtaatcgggtgccaactgacgcaccaaggtactcttgccaagcccttgtgcaccctctaggattgggataatatcaaacttcactccgggaagataaacccgtgcaatcgccccagctaaccacttgcgagttaccatccgtgtatagtgattatcttcggcaccaaggtaatcaatgaaaaaggtttccgcccttggctggccgtcccacttcaccgtttcgatccgttctttcatcgggtcaaacccgtgttcttgtgacgctttaacaatgctatccagcaagttatcctttgacagcaaaatgttatattgtgcgtcaaaatagaaccgtagcaaggaatcatccgtatctcgccaatcgcctttttttagtcccgttttatcattagaacgtaacttcaccactcgatccgagaactcgttataggccaacacaccttttaaattcggatcattttcaataaacagtaaaatattgtatagcgaactccgccgaatagccccctgggtcgttaatcggagttggtcttgccaatcatcaccctttaaagctgtgacgttattaatccgcttgtcatgttcttggatggcttgctttaagttcttatcctctgacacattgacacctcctacgtccgtttaatgatggacttgaaaatagtattaacctctttatccgataagggcggttgtaatcgctcgttagcatattgcagtagctcgtaggccgtcattccattacagccagtccgtagtaacttgcctaataacgaagtcaggtagctattgcgactgccctcgccagtaccagccactaagtcatcaagcatccgtcccgcccacgttttttgaatctgtgaggcgtgctgcggtgccttgttcatccgttgattgggtaacagatcatcaagtaaccactggggcaccgtagcaatatcgttagttggttcaaccgccctataggcactaccattaatcacgctcggtgctactaatacgaagtcagccagcacatcaatacccggatatagacctgttcgccgtttcatatctagcttaaccggcaacttgaagaagtaatgtaagccatcattcggggtatgttcaatataagtgtcactcggtaagggtttgccttgctgattaagttttctcaatgtttccgtgccatcaatatcaccatgtcggtcaatatccaccacgattaacttagcttggtctaaacggatgccaaggttcgcccttgggacatgctcaaaccaacctttaatcgtttctacatccgtggtagcgtccttatatccctgtgtgcctcttaacggcactttgctgttacttgctaaggggtaaaccgcaacaccatcacgggcaagttgtagcgccctcattagcctgtcgtttgctttcattcgctcaccatcctacttggctatcccgactaacgggacttcatagacggatgcaagttgtttcaatgcgccttggttgttcacttcaatgttatggatttgctggctaattttagcccgttgactgtcttgcattaccgtttgattgactagctcttgtaagtagtccagttgcaataaagtgccttgtaaagtcgtcttagcatgatttaattgtgtctgtgcattattcatgatcagtcgccccctgtgagttatcatcaatataatccgagttaccaccagccaaaatggtattaataccatcattaatcccgtttacagtgctattaatgtcatcaataaccccgcttagagcggctgttttgctatcaataagcgctgataattcgtccatttctgttaatacacacatcgtgttatagatggtattgccttgctcatcgatgaagtctcgcaactcgtcgtcatttaattcaaaataattaacgttatcgtcaccagtaattgcctgtttcaaggttggggtaactaattcgctgatagctgaaatactagcatttgccacattaacccgttctatcgtgatagcggcctgcttgcacgccttactaatatcatttaactttgatagttcataaattggcttacccattgtgtttactcctcattttgtagtaaaatgagtatgcaaaaagcccataacagtagtgttttcaggctgtccgtgtgatactttggcgagtaacacggactttttttgtacgctcattcatgttctaaccccttaatctgcctaaccgaaatacttacccggattagcaatcaatttaaatgacacgttgccaaccgccgaaataatcataaacttaactaaactcatcaatagtgttccaatcataattaccatcctcactcgaatttattatatgttcatcaaccgcaattgcccgccagccggattttattacttcatttttccattgtgattgatataaaaatctatgtcgtgcttattaaatagcactgatccattaatgacgtgacctactaatccttgcttcgtccagcctgcaaacgttccctctgatacatccgcatacgccgccgctttcttcttgcgtaaccactgctgactagcacccacatcacgcttggcctgactgattgaatccgtggttagctggtatacgaagtctcgtagtgcttgcgcctgttcatcacttaataacaccttaatcggttctgtaatcgtcctcaccacctctcagcacttagcctaataggttattgcattacggatgctttaaccggcaattgcaactcaatacggtaaatcacgccttgaatctgcaaagcttgcttgacttgctggtagtccatcttcatttcaagcagcgttctaatttgctgtttaacccgcttgactgcatccgcctcactagaacttaagtagtgagtaatagcctcggtcttaggaatattgcgagctttgcgcaactcattcacgttaacccctagtgcctgcttatacaccaacttgttgatattcacatacaagtgaccatgctcacctagcgccgggctttctctaattgcttcatgcaacgacttagaaaaatccttgcctagttcaaacttagcctgccgcaaaattaactcacgtttcataactgtaaactgtctgacaagttcctccttgaaatcagctacccgtggtgtgttctttaagaacgtgatcagcaaggtagcctgttgctcgttgagtaaatagaccttagctttttgaccacttagcataggcttcattttaaatgacaccttgccattacctgcgcgcgccaaccgctcatactgctgattgattgttacattaacagcatggtgggtaattcccgcatactccgcaatcacatcgccagtcgtatatgcttccgcgtccaaccgctgtgatgtcagtgttactaaatccatagcttggcctccttaaacttgcttatatagccaatcattaagtttagtgatagttcccactctcacactagttcgctctccagataaaattttgtctaatgtccaacggctcacaccagttagttgtgctaacgtaactacattaatattcagttcaccacgcttacgtcctaatgccgtccgtagtttgctagaaacttctgccatatagatcacctcactcacattatgtgaatatattatactcacaaaatgtgagtgtcaatacttccgttcacattttgtgagtttaatggtatagttgtgttcaaaaagtgagaggtgacactatgaaaactagaattggtgaattacgccgtgaacatggattgacacttaagcaactcggccaaaaaatccacgtaaaagataacgcattaagccaatatgaaacaggtaaaagaaatccacaactaggattattagtagaaatcgccaaattttttaaagtctcccttgaatatctaatttgtgaatctgataaacgtgattacagcattgccagtgatcaagaggcaatcaatttattacaattgctcgataatagaaaagtcatttttgacaatctatcaaatgaaactgcactaagactggccgtatggattgaaaaccataacgaactgttaagttctgaatatccggaacttttaaaaactgccaaatggttcacatacgaaacaattgacgaagcagatatcctgaaacattttcgaaacaatagaattgtgcaaaatgatgcctttaataaaattgagaagcttctagtattagattatcaagatgataatatcgataacccatactatggccctgatgccaccgatgttttagaattcatgcgacaaggtgaaagaataggcgttgaaaactacaaagcaattttggaagaaatgaaagctatgccttcatatactcctgatgattaatatttctcttttacataccttgcccgccagctggtatgaaaggaataatcaatatggctacattcaaacagtataaaacgaaatctggtgcgttctgggaggcgttcacatccgtaggtaaagataccaacggcaaagccaaacggatgcacaagcgtggttttaagacaaaaaaagaagcccaattatggacttcgaatgttcagacagattttactaagaatggtttcatagcaagcaataatatcacctttgccgaactctatgataaatggttcaacgaagattacaaggaacaagtcaaagaatcaacgtacatggtaacagacgacatctttagattgcatattcttcccgaattaggctctcaacgggtaaaacgtatcacagtagcccaatgtcaatcaatcgtgcacaagtggcttaatcagggtttcaaaacgtatcgccgttttaggacgtatgctattagtgtttttgattttggcgtacgaatggaattaaccactcgcaacccaatggctaaaactagcattcctaaacagaaaacaaagccacaagcgccgcacatagatttttatgagaagtccgagctagtgcaatttctaaattgtgcgtcaaaacatgaaaacccccaagcatttatgttcttccgcctactagcctttacaggtttacggcgaggtgaagccttagcattgcaatggagcgacattaactttgagactaacgaactaacggttaataaaacccaagctgtaggtaaacgttggcgtacgatcatacagacaccaaaaaccaacagcagttatcgcactattgtacttgacccagataccgcacaatggttgcacaagtggaagatgacccaagccagacaatgttttgaacttggattcaacgctaatgatcctagtcaactggtatttactaaccaacaaaacaagctgatgtcacctagtacagttaactattttaattggagtatctgtaaaaaatacggtttgcgccatataaagattcatgcgttcagacatacattctgcacgctagcttttgaagctcatgcgggaattaacgaagtgtctaagacgttaggacatgctgaccttaaaatcactgaacaaatttatttacacgtcaccaaaaaacaaaagaacgagactgcttcaaagctagctcgttatatgagtgaattatgagaatataattttgtggtgcatttttggtgcacttgtggtgcattttatttgtgccttattgtgtcttattacactcaaaaattaataaaaggctgctatacgggctattttaagtctcattgtggttcattgtcagtcgccattcaatcctatttaactaagttagttaattgcacaaaacttaaattcgcattaaaataatcttaataagttaattaaggaagtgacagattgtgaagggcgcattgacaggctggcgccggaatctcgctgttctctggctaggaacatttatcgccggaatgggattttctgaagtcatgccattcttatcattatacgttggtcaaatgggggatttctccaaaaacgaactcacgatgtatagtggtattacatacgcagtgactttttttgtcgtcgctgttgtctcaccattatggggtaaactcgctgaccggcgtggtcgcaaaatcatgctgctgcgttcttcgcttgggatggcctttgttatcggtgcgatgggatttgtccataacatttggatactcattctacttcggttcttacaaggcctgtgtgccggctacattcccaatgctagcgccctaatcgccaccgaaactcccaaggaaagtagtgggaccgcaatcggtatcctaacaactggctacgtgtctggtaacttgatcggcccgattctcggtggcgtactcgcccaagttttctctattcgtttgactttcattatcaccggaattttgctactgatcgtcttcgtattgagtctgacactcgtccacgaaagctttaaacccagcgacgcgccgattgctaaacgtgacggcagtctactcagccaatttaaaaatccaacgttgattatcacactgctcgtctccacgatgattattcaaatggggaataattccatcacgcccattattagtctatatgtcaaagaactgatgcataacgtcggcccaatcaccgtcgttgctggaatcattgccgctctacccggaatttcgacgctattatcggcgccgcgactcggacggctcggtgatcaccggggggctgaccgtatccttgtctttggtttcgtctttggtttcgtctttgccatcctgatgtactttccacaaggcttcgtctccagtgtgtggacattagggctattgcgcttcatgattgggatctctgacggggccctctttccaacggtgcaaacattattatccaaaaatacaccccgcgagttaacaggcactattttcagttggaatcaatctttccaagcagctggcagcatgctcggctccttacttggtggcgccgtctccggctggttcgattacaacggtgtctttatcttcaccgccttgtcattactgcttaacttcatcggcgtactgatctttataccaagtatgcggcacccatttgcaaaacactcggttgattaaccgcgctatttatcaagttcaaaagctatcagcttagtcccggagatcggaccaggacgcggaccggctgacaaacactaatccgactagcatattttaaccataataaaggtcaccaatcagcaatcgctgcttggtgacctttattagttattctattccgttagctcttacttcaaatattttgccatgaactggcttactttttgttgatatagttgcggataacgcgtgtatgattccgcgtgaccagctcctggagccacccataattgctttgacttgaccgtcgtagcgcggtagttctgatataccatcttcgtggggacaaaagtatccttagcaccatgaataaagaagattggcaacttattcttcttgagctggtttactgaactcgccgtcataaagttgaagtgggccttcgcttgagctacccagcttgccgtatacagcagtggaaacttcggtaagtgatatagttgattcagctcatatcccaattcatcaccaacactggtatagccacaatcttcaataatcgctttaacttgtgatggaagtttctcgccactcatcatcatgacagtcgcaccacccattgaaacgccaaagagtccaatctgactattttggcctacgcggcgaatcacctgtcgcgtccactttagatagtccaaccggtcaggccaaccaaaaccatagtaatccccctgactctgaccattgccacgatcatccggcgccagcacattatatccttggcgatgccacaatcgaatatagctcgccatctgctccttgttacccatgtaaccatgcgccacaataatcgttttggtggttcggtgcgcagctggtacatagtccgcaactaacttcaaatgatccgttgcggacgtctcatgccaggtctgcttgttgacccgtttcagccacgcttggttctgcttcaacttacttttactcttactagaactatggttcaaaactttcggggtgggttcaaatgcaaagtgatataaataaaaactaccgcccgcgaccccaatgacgatcacggtcaagaatgcaatgagcgcaattgtccattttttgcgtgttgtcatattctctttctctctttcatacctaatcatatctgctaagcctaattcgctttaattcgaatacgctacaagcagccatagcgatattatcaaacgctattctcaattatgtgcctatctcaactcaatctaccaattcgttaagcgctcggatcgttaataaatgtgccgccaccgtttgagctgctaattgaattgcccgtgctaacgggtcaaccgtcgacaagacgaccggttgtccagcaagcgtagactcgaatgcttgccgaaattgctggtaccgcggctcaatctgacgcgaatcacgaatttgcaaaatcgctttactaattactggtaatgaaaaatcagtcttcaaaattgaaacgactagtaccgccacaatctgattccgggtataccgatgtccaaccggccgactgaaaaaatgttgtttcacgtaactattaatcatcgtcttcgttacggcaggtaaccccagcggctgaattgtttcattaacaagttgcaacaactgttccatataaacgggcaccgcgggcaactcttcccacgaaagtaaatagttactagttgatccaaattcctccatcatccaatcctcctcactaccctatttaatttagcccaatttagattttaattcaacaatatctaatcatcaccttgttataaatagaattataatctatatatccactctgctaattattattcgcctcaaaaattattaaaaggtgcttatttttggattgctgttcgtcagcaatgatcgtcctattccnnnnnnnnnnagccggaagcagaccacttccgactaagaataatttggctactgagtattgtcacccagcccctccagtctcaagcctgtgaggggccacgggttgaagccgagcattgcctagccaacggattaatgcggttttggcattagtccgttggcgtagcaagcacaggctttagtggcaccgaacacctttcggtaagccgctcgaatggctgatgaacggccacttaacttagcacaatttatcgttgactattttgatattaaacaaagacaaagggttagggtgcactaggcactctgtcagaagtttgaatcttactatgccgattcaggattaatgagctacctcaatatcattttcagtttgacagttgattaacaaaattactgtttacaaaaagcaacggcaaattcatcaaaagttaagtacagcttcgtctgccattcgaatactctcccgactggaaggcgtttctgacaatgcccagtggtgaaatttcacttagcaagcgtcctgtgcttggttagtgaaaggccagtatttgagacgtgatttttcggctcaagtctgtgcccaccacgttccggcaattggcagaaatgcctggaagtcggtgtaggaccaaccaactaaacaagtttacgctgattcgaactttttccagcgggcctaagctggctatttttgaactttcaaaataaggatcttttaataatgattcacgccaaatcaaggcttgaaagccaccccatatttccgctaaaataggcttatccaaattttgttatccagaaaggaaatcattatgaataacgtttacctagctgcaccgttttttgacgaggctcagaaggaacgcatccaacaagtgaagtcggcgctgttggctaacccgacgatcaaccccgatggtatcttcatcccagaagaacatcaatttgaagaagaaccttttggtagccgtgcttggcaacaatacgtctacgcatccgatatgcgtcaagttcatcgggccgatgtcgttgttgccattcttgacttcgacatgactagtgcaaccaatgagccagattctggcacaatgtttgaaatcggtgcggccgtggctgaaaagacacccgtcatcgtcgttcagtttgatgcgaataaagaactcaacttaatgattgcccaaggattaacggcctatttcgatgctagtaaagatggtctgaaagaattatctgcctacaattgtgatgacttacgttctaagcccgctcaccggccagtattttaggcacacaacttaatgacacgaaaaaatgctgcttgcaaacgaataacgtttgtaagcagcattttaactaacttgaattgatcatccttattcagcagtattcacgactaatcgtgactgtcgccgcgcctgccagcgcttattcaattccagcacgaatgttggaatcagcgtagctactagcaccgttaaccatcctaacgctggtagtgtcactaagctaaagaaactacggaacggtggtatcactgcaattgccaagaccaccagaattcctaacagcaatcctcggttcagcattggattacgcgtcatgcttgaccagctgagtggtcggcgatccttaattgcatagatgtcgatcattgatcctaatgccaatactagaaagaccatcgtcatcccgactggggcttgaccatttgttaagccaaagcggccaaacgcgtaaattccgagggttagtacggtaaaagtagctgcccggataaacaaccgttgaccaaggccccgagctaaaatactttcgtcattggctactggtggttgttgcatggcttggggttcacctggctcttggctaataaagaatcctggaatcccatcagcaagtacgttaataatcagcaattgttctgctaacagtggcgccccccaaccgaagaggactgcaccaaccatcaagaagatttgtgcaaagttgacacctaccaagaattcaacggctttaatgatattctgataaactgtccgaccttccttaactgctgccatgatcgtcgcaaaattatcatccgttaacaccatgtcagcggcttctttagatacttcggtacccgtaattcccattgcaatgccaacatccgccgctttcaatgccggcgcatcgttgacaccatcaccggtcatcgcaaccgtcttaccaagactttgccaagcctgaacgattctaattttgtcactcggcgacactcgggcgtacactgcaatctgatcgatttgagccgtcaattcttcatcgctcaattggcgtaactcatcaccgctaattgcttgcagctcaggggttaaaatgccaatttcctcagcgatagccttcgcagtaaccaaatgatctcccgtgatcataactggaaaaatacccgcctgtttggctgctcgaatggccggaatcacttctggtcgtggtggatcaatcaaaccaatcaatcctgccaattggaggtcagctgtcaggtcgtcccagtcagtagtttggacatccgcgggaatgatgcgatagccaacagctaaaacgcgaagcgccgcctgcccaaattcatcatgggccacttgtccagcagctaggctagcttggtcaggcttcagtggtaaccgatcccaagcccctttgacgataactaaccgtcgaccatgcgctaattcatgcaccgtcgtcatcatcttcttagttgagtcaaacgggtcttccgcaattcgtggggtctgcgcctccaagctgggccgatctaaatcatactgagccagccaacgaataacggctaattccgttgcgtccccaatagcttgttcttcaccgtcaacgtggttgatctcggcattcgtcgctaatcctaagtaacgcatcaatgtttgtcccgctgatggcaagggctgttcggtcgtcataatgcccgtggtcggcgtccaatactttgtaattgtcattcgattttgcgtcaaggttccggtcttgtcagacgcgattacatcgacactcccaatcgtttcaacggcactaactcggcgcatgatggcatttctgtctgccatccgtcgaacaccgtgtgaaagactaatggtcacgatgatcggcagagtctctggcacggccgcgaccgctaatgaaaccccaatcatcaagctatcggccaaaccttggttttgcacccaaacactcagcgcaaaaatcgtaataccacctaagacggcaaatgtcgttaaccagcttgatagccgattaagccgcccctgtaatggcgtggcccgttgcttcgtcttgttcaacaaacctgcaatttgacctaactctgtggccattccggtcgttaagacctgaatcaatgcagtaccggctgtgacggccgttcccgcatacacttgacagttatcatccaactcaccggtgtcctgataaatacttttttcaacagcttcactttcacctgtcaagactgcctcatcaacggctaagttcgtggcctctaacacgaccgcatcggctggaacctggtcacccgcttttagtagcactaaatcaccgggaacgatttctggtgccgcaatcgtttgtaccttcccatcccgtcgaacattagctgtgggtaaactcattgacttcagtgccgccaacgacttttctgcggaagcttcttggtacaaaccaatacagacattaataactaaaatggcgccaatcacaatggtctttgtccagcccccattctgggcaagagccaagtacgtggctaaaccaactgcaaataataatactagcgatgaaacgtcgctcatatgttgccaaattttacgccataacggtacggggcgcgcagccactaattcatttttgccgaatttagttagctgggtcgtcaccgctgtggtcgttaaaccggactcgggggtaggtttgaatggtgcattctgataattctgcatcgtttattcctccgtaattcgattatcattgtcattcgtcactattaatgatagcggaaacattttgtcgttttacgtacaaattgtgaaaaagtcgtgaagattagaacgtacaattaaagcagccattaaacattaaccacaggtcatcatcaaaaaactgttcaatttatgactaaaatcaagttaccagccatgaatattgttataatagaacacaaatattccttggaggcacgttatgaaaatcaaattaatctcaactagtgatgtgcacggttacctcgcgccaactgactacagtcgtcgtgataacatcgcaccatttagtcttagtcgtgccgctactgttattcatcaactgtcacgtgaagatacggctgatgtctggccaatcgtgattgataatggcgactacgtacagggatcaccgttgacctatttcattgctcgccaccaccaagaagctgcaccgttatactcgcgccttgcaaattgcaaccacgttcaagccggtatttttggtaaccatgaattcaactacgggctcgactacctcgacctgtgtgaatcaagccgccaatatccgatgctggccgccaatattcatgatgacctgcaccgcaccttattctccaaaccatacacaattctggaacgcgccggagttaaagtggcaattttgggactaacgacacaattcgttgcccactgggaacaaccacatcacattgccggcctgcactttgaggacgtggttgcaactgctaaacattgggtgcccaaattgcgccaactggctgacgtcgttgtcatcgcctaccacggtggtcttgaacgcgatccccaaactgatcgtccaaccgaacgcatgaatggtgaaaaccgaggatccgcactattagctgaagtacccggcattgatgccatgattactggccaccagcatcgacaattagccgttacggttcacggtgttcccgtgacacaacctggtatgaaaggtactaatgttgctatgattacccttgagctcgaccgcaatcatcaagtgacgaccagtcatccggaaatctatccggtcgcagatgccacccccaatacccaggtaatgcaactagttggaccaatcaatgaccagatggaagactggttagacacaccacttggccaaattaacggcaatatgctcgtacacgatcatcttcaagcacggctgcataatcatccttacatcgattttattaatcgcgttgaaatggccgcaaccggtaccgatattgccgcaacagcattatttaatgacgacgtaccaggcctcaaacaacacgtgacgatgcgggaagtcatgaacagttacgtctacccaaacaaacttgccgttgaagccattactggtgctgatttacgcgccgctcttgaacgttgtgcgagttactttttcctccaagacggacacgttcgggtcaatcccgagttcatgcaccctaagttgcgccactatgtctatgatatttacagtggcatcgactatactttcgaccttaccaaaccctttggtcaacgtgtcgtccaactcgattatcatggggccccagtcaccgctgaccaaaaattaacggtcactctgaatcattaccgcgctggtggcggtgggaattacccaatgtatcaaacggctaagattatccggcgcttacctactgatatgaccgtattaattgccgactactttgcgcaacaccccgtcgtcaacgcaacgcaaccgactaattttcaagttcactattaagactaacgcgacaaacccgctcaaatatgccctatttgagcgggtttgtctatactgacgttcacaacgtttggtttagcatcgtcgttaaaccgtgccaattaacctttgtcaatcgggaatcataacagcactgaccgcaagtcgtgccctcctttgtgagcacctcacaaacccagcatggtaatcaaaaggtgcccgtcatacgagctgcaatccccacattaagaatcccatggtcagcggcgcaatgaccgtacttaacatttgcgtcgccacatactcatctggtgccaagtggttttggacggccaacatggtcgcgatggttgcagtggggattgcgagtgtcaagacaactaattgttggttacctaatgacacacctagactagccataatcccccaaatgagcaccggtaagcctaaatttttcagtagcacgtttaagacaaccatgcgcgtcagtcgccacggtctggtcgttaacagaagccccagcgcaaataacgccacgcccccagctgcttgtcccaactccgtaaaattcgttagccaagcactgggcaaccgcaatccggccaaattcaagagaaaagcactgattggcgcccacacgactggttgccgactcgcacgacacagtttctgccaaccggctcgccaacgttgctcaggtgtcgaaccgcccgctagcgttaacagcaacacgctcactggcacttgtaccaaattcatgtacaggccgcctaacgcgaccaataaaacactgattttaccaaaaaccaccagtaagacggaaacacccatgaatggaattgaaggactggcgatcactagcgctcgtaacgtccccgtttctagttgctgatggaaacagcattggctcacaatgacgatgaccatgccacctagcatgcctagcgccaaccacagcgcgaccgaggagttttgaataatggtagcgcgctttaatgacaagattcctccgaaaagacttaacggcaaggcgtaatgcatgaccaactgaatcaaaatatcactggtcgttggcgcaaattggtgccgtagccccgcaaacacgcctaatcccaccgtcacaacaattggtaaaattgctaatatcagtaacattcacaggcccccagacttaataattaaaactgagtgtaccatagtccaatcgctgtgatagtcaggttgctagtcaacaatcggacatcttatgacgtttcattagtctaattaggggcctacctcatattattaagcggccgcgccacactttttacgataacaacgaattttctaatttaactagctgactccgacaattaggtgattagccaaataaaaaggatgctgccagtggctgcatccttaataacgatgaaacttagaaattaacttgatcaggatcattagctaacccggcaacaccgtggaaaccatcaatgaccttcatatcatcatcgctgagttcgaaatcaaataattccgtattttgtttaatccgatccgcatgaactgattttggtaatggtaagaaaccgtgttgtaatgaccaacgtagcacaacttgggcaacgctcttatcatacttatcagccaacgtctttaattctgggatactgaagatcttaccagtacctaatggactataagcttctgataaaatgtcatgtttgcggttgtaggccacaacttcatcttccatatcactaggattgaggaagatttggttaacggctggcacaaccttggctgtcttaagcagcgcgtctaaatgcttaggccggaagttagaaaccccgatagcccgtgctttacgtgccgtgtaagcttcttccattgcccgccaagtatcggcgttcaattgttcccaattgtcgcgcattgcggctgggtttggccagtggatcaagtagaggtcaacatagtccaaacctaacttagccaacgaggtatccagcgccttcttggcagcgtcatagccatggtcggcattccataatttggtcgtgacgaataggtcttcacgtgccacaccactatcggcaatagctttaccgacactttcctcgttaccataggccgccgccgtgtcaatgtgccggtaacccgcctttaatgcggctaatacggaatcgtaagcaacctgaccatcaggtgtttgccacgttccaaaaccaacaatcggaatcttagtgccgttatttaacgtgtacgtatcggtgagtttagtcaatgcagtcatcaaaaatgcctccaagaatttatttgttaagataattctacccataaccgaccacttccggcaaacattctgttccaaactaatgacgatacgcaaaattcgtgagaaaatataaacattctgatgtgggaggggttttgatgagcgatacggcagttatgttaaaaaccacgttattggccggcgccattttgctagaaaatggggctgaaatcaaacgagttgaagacacgatgcaacgaattgcaaccaacgcgggctaccctgacgcgcaggtcttcgtactgttaacagggattaccgtctccttgccggaaaatgccactagcgaagtgcgagcaatccataatcggggtatggacctcgaaaaagtggatcaggtcaacagcctgtcacggcagtttgctaatcacgatattgacttaactgaatttgccgcagccctcgaacgggtcaatcaagccgtaccgaccttcccattcagctggttatgtctagcggccgttgtcgttagtgtgccgttgatggtcgcctttactgggcggacaactcctgccgacttgatcacttgtgggctagccgggttggctggttttgctgccttttattggatcaatcggctggggtcaattcggtttctcagcgaatttatgggcgcttttattattggtctaattaccctactcggcttttatctcactaacggtcattatcatcccgacgccatcattattggcgctgtgatgccattagtgccgggtgtcgccattactaatgccgtccgtgacacaatgacgggtaacttgctgagtggtcctgcccgcgctgtagaggccgttttatccgcgtgtgcgattggtgttggtatcgcactgacttcatttttctactaaaggaggcgtgacatgctacattggctcttaacaaccggtttatttcaaattatcttagcttacttagctacggctggttttggggtacttctcaatattccgcgtcgcgccgttaacctcagtggttgggtcggtgctgctggctggtttacgtatgaggtcctctatcacatcctgccattaggaatcgacgccaaacttgcgattggtaatctcgtcgcagctatcgtgattggcgtcgctagcggtatggccgcacgctacaaacgaatgccgatgatcatctttaatatccctagtctggtcccactggttcctggtggccagtcttatcgagtcgttcgtaacttggtcactggtcaaccagacttggcctaccagtactttgtacaagttgtcattattgctggcgtgattgcaattggctttctcgtcgctgaatttatcaatcacattactttacactttgtttaatcagaaaaatcagctagtgcatctttgtcggttagcaaaatgacaccacgttatcttgattttcagctgttagacttcttaaatgattagcaaaaaatagataacgccttttactaagtacttacaataaaagtaagttaataggtctaatatagttcaaattgtgggcttataagcctgcaacatttacaataataattgtatttaacccgagattttctaacttggagggagaaaagctcaatttattatttagatactgacaaaataagcttagagaaaaagaaaaatacccttggtaagattggcataaaattatgaccttcattaatatttttcaaaactgtaaattcaattaaaatactgcctaattacgattctacagctgcaatttcaatgtgattgcgaagccttaaaaagtagtatacgaggagaatattacaatgaatactaagtctaatcatctcatcgaatggctgctcaccttattattaataatctcaattctgataaatgttggttggtttatttttcgatatggcggtcattactactacatgaaaatatcgagtagtaccggaacttcccccattacactaccggtcaatatcccagctactgggtatcaataccaaggactagcaactaattctaagggcgaaaaaaagtatcttcattttaatacagttgctgctgatccagccccattcaaacgcggacaaattgtcagaatcacattcaatcaaaggtacggcgtaaccaactataaattagttcatcggtaacacgattacttcaaaaaagccgtcataacgattggtttatcacttatccaatcgttatgacggtccatccattactagaatgatataatctaaaaagtcagcaactaatttatagtcgctgactttatttattcatgatatttgcggcaacaagcttagccaaaagttacgcttctagtatttaatgaatcaacgtaaagtagccaatcacaagtacccccaggacaattcggtaccaaccgaacgccttgaagtcgtttttcttgatgtaatccaacaagaaacgaatcgacaagtaagcgactacgaaggacacgatcaccccaacggctaagactgctccttgcaaaccagctaaagaaccaccgtgagcaaagaatttcacaagcttcaataatgacgccccaaacattgttggaattgccatgaagaatgaaaactcagttgcgacgtagcgtgaagttccaatcaagatagcccctaaaatggttgcaccggaacgtgaagtccctggaatcaacgagagcaactggaagcacccaatgaacaatgccgtcgtataaggtaacgtttgtagattagcgaagcggggtgttaagcgcttattatgattttcaatcacaatgaataggaccccataaataatcaacgtggcagaaacgaccgcccaattcattaaatgttcgtccatccaatcatttaacggtaaccccacgatcactgatggaatgaccgctaataacaccttactccagagaacccaagtatttcgcttttccgtggtatccttgcgtggtgacaacggatttagtttatggaaatacaggacaacgaccgccatgatcgcccctaattgaatcacaacgttgaacatatccgtaaactgcgtggactgttgcatcttgataaattcgtcaactaggactaaatgccccgttgaactaattggtaagaattcagtaatcccttcaacaatccccaagattaccgctttaaaaatatctaacacaatggattcctttcttgttggcaatgattatcgcttgataatcccaatacataaagatttacgaccatccccgatggccggtatatcaacattatagcaagcagctactcaagatagtagcgtccatgtgtatttttttggtaaagattaatttgtcagcgctgccaacgccgtactaaatacattttgcgtttggtcatcaaaacaaacaatcgtgattgtctgaaccgtgtgggccgttgtctgcgcggttgcttgtaacgtttttaacgctaacggtgccgcaattgatagcggaaagtgatagacgccggtactgatagacggaaaagcaaccgtttgacaatgattctcagcggccaaattcagactgttgcgataactgttcgctaacaattgtaattcattatgctggccaccttgccaaacgggacccggcgtgtgaatcacatacttcgccggtagtcgaaagcccggcgtaattttggcttcaccagttgcacaaccgtgtaatgggcgacaggcagccagcaatgctggcccagctgcccgatgaatggcaccatcgacgccgccaccaccaagcaaactcgtattggccgcattaacaattgcatcaacggtcattttggtaatatcaccgtgaatgactttaatctcaaccatcttaaactgcccccataatcagattaacactcgtttgggcctgttgttttagctgtgccccactaggatcctgttttgccaataactgaatgccgctgcgaacctgcattaaacttgctgcagcctcagcgaccgtggtcggtaaggttttagcctgaggtgaaagtaaaccgacgagtcgggtctgtaaatcagcatagatcgtttgcagttgggccatcaaggacgcatcctgcgacccaatttcggccatcaggttcaccatcaaacatcctgctggccaccgttcactctgaaacggcagtcgcaaacaagccgcaattaaagcgggcaatggtgtttgccgcgcccgctcacgttgaatcaattgatcaagttgttcatctaacgttatttgatagcgttcaagtgaacggcgtaacgcaacccgcttactgtgatactggcgataaaactgcgttcgtgacaactggctaacggtgagcaagtcgtcaactgtcgtttgataataaccacgctgccaaaattgaatcatcattgctgtttcaaccactgatgcgtccttaacaaccatgctaaaccctcctgaacctaacgctactacattaatcagcaattaaatactgaattccgcgaataatcgaccataagtagctagccactgcgactaatccaaataccgctaaaagaaccacggccaaccagccactattaacgatactgtccatataaataccgctaacgcctaaaataacgagcagtgtaattcctaaaattgtcggcaacaaatgtaaccaaaaagcccgtcctgcaacccgatgtgcttctggattagtactcgtcagcaaccaaacaattaatggaaataaaactggtaagaataaaatgcttaaatagctcaacgcgttaatcacccgattttgtgtcattgttataacctccaccgatatttatttcgagtatagcgaaagtctggtacttcggcaaataataaacaaattgttaaaatacttaggactctcccaaggttacgcgccgaatgttaacttacgaccacggtctgctataataatgacataacctaaccttgcaatcgctagttgccactgtacaacccgggagcgaacggttcatgttaggatttaggtgcattagttaagatgcggaggaaaagaaaatgacgaaacgaatgagtttcaaatttaaatgggttgccctcgttgccaccctgatcgttgggattggcagctggcaagtccttgcgcacgctgacagtagcagcgatgaaccaattgtcacattaggcagtagcctgactagcagtcaaaagactgggacgatcaacacgttaacggctagcttgaacggtgccgattatcagacgctaactgttaacggcgatactctagttaaatacctcaacccatccggtgaaagtttcacaagtagctcaggtgtgtggtccagtgcgatgattcaaaaaacaagttctggttctggaattaatgtcaaaattttaaattataatggtagtaataacatcaccactattacggctaaccagtataaaaacgccgcactaacggctgggattaccgatgctaatatttacgtcacatcagctactccaatcgacggttcgggcgcactagccggtgtttacgcagcgtacgcaaaatctggtaacagcttaaacacgaagcaagtaaccgccgcccaagatgagttaagtactctcagtggcatcacccaagcaaataagagcaaggatggttatactgattcccagttgaacaacgctgtggctggtgccaaaaaggaaatggcccaaaaaggaagtaacatcactaaaaacgaaatcacgaccattgtcaatcaacaaattaccaataacaatttaacaaatgtcattactaataatcaaaagactgaaattattaatttgttagtcaagatccgtgattcaggtgcattagattcttcaagctttaagactcaagccaactcgttgatgaagaacattcaatcaaatgccaagggtgtcttcagcaaactcaatactaaagaaaatcaaaacttgctccaaaaaatgtggagcgcgattgttaacttcttcagctctattttcaaatcaatctttggctaattattaatctcggatactcaaaatcggacgacaaaactgcaatcagttttgtcgtccaattctttttaagccttgaagcataccattaaataacgatcactggcttggcaaactattcaattgccaagtgatagttccagaataatttttagccatcacacgaccacccttgacgtgcaacgcaacgttattaacattccaaatttgttgattagtcccgacgccttgttgactagtcgtcccagctattaacgtttgttgggtagcacctggggttaacttaatcacggctggtaaggttgcctgattttggtcagttgccgtaacccatttactagtactagcattcaaatattgcgctgttcctgatgttaacgtcacgtaactacccgtcatggtcgtcccatcagtagctgtcaacgctgataattgggccgtcaattgccaaccacttggggtgtcccgtgtatcagtcacttgtgtatacacactatcctgcccatttttctgaccaccaactgttgcatacttctgtccatcagtagcagtagccaattggtcttcagcggctgatggtgacaacaatgggtacgctgtatccattgttggaatgctgtgctgtccaaagttcaaatgtgtaggtacagcgtccaacgataatgggcccaaattgttcgtcccgccagtcccaggcttgctaggatcatcaggatcaattggattgacgattaaatccttagctactgtaaatatcggtgctggttggaaagtcgcatcatgatactgctgcccatttggataactattaggatcaggattacgatttcctagactatcagccatataaataataatcttgtcaccaatttttaacgataatccggttaagttcagtgaccaagtcccattggcattggcaaccgttttgacattagtttgaatctgcccattcaatgctaatgtgacctgcgcacctggctctccattttgaccactcaccgttcctgttgaaactctaatggggtccggtgataccattgtggccggattaggcggcgtcacatcaaccaccgtcccggtagccgtgaccgtcgttccactggtattgctagtcgatgctgtgaccgtcgttccagcttttaaaaaggtcccgacattagctgttgcgtagccattactatcagtttgggcagtgattgtcttaccattaacgctataactcacggttaattgccctgcactagcatactgtggaatataattaaccgttccgtcatcttgaacaccattagtatcaggaaccatcgccacaatgactcgcgtccgcagcttctgatccgcatctgttagcttggttgtcccatcatacggattattaaatgctaattgtggcttctggttagtggcactaatccgacgcattttagaagataaataattactttgcaaattactatccgtggccgtcactgctgaaccctgttgtaataactgagatacgttactatacgaataatccgcaccgcccgtaaccgatgatgctaatttccacaagctaatattactatcttggatttcaaaagtgcccacattatcttggttaatcgaactagccgctgcagtcgttccagttgagctattacgtaaatccaagttgttcggattaataaatcgaacagtagccaaacgcgcgtaatttcccgaaataagcggtgctcccgtagcagcaattacataaatattggcaccactactactttgaatcgtcgaagttgcattatcagaaaaagagattggcgattgacttctagctagtgacgttagattaacggtgctaccagtatccgcgtaaaaattacgatgatattgtgacccataaaagtacttgttagagtatgcatttcctggcacgctagcattaaacgtggcatttttacccacattaatactttcatacgcatcaaaaataaccggataggtagtataggcggttgacgtagaactagcaggtcgtcgaatacaatttagcgtcgcgccttcttcaacattaacttgccgattaccagttccttgatagtcataaacaaaccagataaatgaattatcatcaccattggctattttcgatccagtgaatgtctgtccagcagctacatcaaggccaccacataagatgttttctcgaaccgttgttactcggcaattgccggtaatattgacttggttcccttgcgcactgacaaatcgccgacttgtattggtataactagtcccacttgggaccgtaatattactaacattaaatgtccaattcaaagcccctccggcaccatcgccaccggtggatgagccaatcaaacccgcatcatttccaaaagatccgattaatgatgcaaaattcataaaagtggccgtgtacatcgtaccgctagttgcagtattatttcgggtatgaaaaccagcccgaccaatattcacgctatgaccatttccattcacaataatattaccggataatcgtgaatccaaagcacctgaagcggcagtcggattactaatatcagccgtaatattaatttcatcaacactcgcatccttccaagcatcgactaattgagaccactgactaacatcaaccacattcgaactcagctgagctaaacgagtgactggtattaatggactagatttggcactcgccgttgcttgcttagttggtgctgatgagaacacttgactagcagtggatgacgatgagatgctggccgaactatcagttgtctcacccgcagattccgtgaccgatgacgattgattagcagcagtttcttgtgaaggctcgctactgctagcactcgtttggtttaccgcctgacttgaaagcgtcgttgccgctgaacgtgaactgtccaaacttgctgctgatgatgtcgcttgtcgacttgacgatgccgtcgaactatttgtatcggttgccgctgaagaactagctgaactcgtactggcctgatcagcctgcgtttgtggttgcttaatctcgacattcaacgccggccctttttgatcatcggctacagcaactaacgccagtttttctgctttaacagctgttaatctaattggtaccttcgtttgcggatattcatctgaccactgaaccgttatcctgcgcttatcaggattgtacgaaactgtcagatgcttagccgtaattgtaaaggcgccattatcccccgttgtgtactgactatcatcgaaaactcgttttatttgcttaaactcctctggcccatctaaattaacctcgttcggtaaatcaatcgtatttattttagaggccgtatcaccaatctgtagttcaacatcaaaatgttgattcgttaaaatattatcgctagccgttgattttgcaaaagttaactgtggtaacgtagctgcttgagcggtcatatcggcgcctaagcttaccgttgcaccagcggctatgacttgtaacaataccatcaatatgacaacaattgctcttagctttttgatagtatcaccccttagcgcttattttgacgccgtttaattacccagaatatgattaaagcaatgagcaataatactaacaacacgataccaatcaaccaaccccaagtagttggagacgtgacgttaacagcatccgtagcgccaactacaaaatcttgctttagcgaccagacatgcggcttagcgaacttttcatccgtagttcgatacttgacgtatagagtgtaagtcccaggtaaaatgatcccccgattagtacgccactttaatggtaagtcaaagttagaattaggagccatcgaactactttttagatcagccaccgcgagctttttggtctgcccagctttgctaacgtaggcagtgacagtccctttgcctagaattgaagcgtggtaattttgaatattaccgataactgtcttgatgccactccgcttttttaattgaacatcagccaagcgtaattttggcaatggatcacgatttgacgttagtttgatccccacattgtaggcatattcgctagttaacgtcgcccccttggttttaagatgttgatctgcaattttaacttgccaacttcctaaaataatccctttgttcaatttcgttggcgtttttaactgtgcccgcacgatccgtgatttattagctgggatcgtcgtttcctcatccggtacggtaataatatcagctagttttacttttaaactagtatcatcattcagattagcagcaccataatcaataacacctttcgcattagtatacgattgtaggaattgatttttgactttaatttcatgatttgagcgattattaacacgcatcgctaacgaatatgttctcttcggttgaattttaaaatcccaataataagcgtcctttgataattgttgcttttcattaagcattggctgaacatcaaaagttaccgcattattggccgtgtcagcagcatggccaatcacagtcataccagccaacaaagtcattattagggttaacatccctaataatagcttcttattccagccgttcataaaagggcctcccttcaaaaaaacgagttaactattcaacatagccactcgttttcgttcattaagccgttggtgtcgagttcaatgtccaaacaatattccctgaataattcttagcggctgcgtgaccacctttaacatgtaattgcacattattaatattccagtattgttggttgacccccataccttgaccgtcaccaactttagaccctgccgtggctgttgcaacatcggttgtcgatgaagcgccggcattgagcacaattggtgttgcaacggttgcctggttcgcatccgccgcagtgacccaagattgttgattagcttcccctgtcagatattgtggtttcccaccacttaaaacaactgacgcgttcgttaacacttggccgtcagaagccgtaatatcagaaagctgtgcctttaattgccagccagcaccagtcccccgtgagtcagaaacttgcgtgtaaatgatatcattaccatttttcttaccactagtcgtcacattttgggtcttatcatcattagctgtcgcaaggctctcctgactagcatcttttgaaagtaaagtgtaggccgtatcaacattaggttgcgtatgcgtcccaaaattaagatacgttggtaccgcatctaacgaaagtggcccgttgttcccagtaccaccgccgccaggattatccggattgtctggatcaacaggattagtcgaaccaccgttagacgtaaacgaaacatctgcttgagactttccagttgaaggcaaggtgtcagcggaagctcctaaattattgaatgataaacaagcaatactggctactgaaaccaacatagctgctttgagcgtacgtgactttgtcataagtcaattccccctaaaatttaattagcatattaatcttcttcatcaatagcgcgtaatacctttttgtacaaacatattaatatttaaatcaatattataaattcacctttattaataaacttttagcaaactaattgacgaagaatatttatatgtctatactggataacttaaatcagtcattatccttgaaccaattaaagcataccaattaaagttaatcaagtacactattatgtacgtttactatttgtataaaattcactatttttgtaacttatgggggaggaactgtccattgaattttccagagctcaaactttctcaaacagaacgcgatttcaattttgattttgctatattggaacatgatttaagttattttttcgaaaagcgttgtcttgactacgccttggaacatatcaatagatttaatcacaaaatcaaggataacttatacaacgtccgcccactcattctaaaagaagccttaatttcactaacctgtgatctagcaagtgtcagcttttatcattatttgaacatgatcacattcgttaacttaagaaaggacattttgcattacctcacaacaacaacactaacgaatgatgattttatgccacttttagagtcaatcgttaacaattattttagcaatcttgatacacttgatattccaattgatggtacccgcctctctaagcaagtcgcgctagttgtctattatattgataatcattgtgatgagccattaagagcaaataccatcttagaagaactgacgttagatcctgaatacactaagcgtaaatttcgtaaagaactagggtttaccatcaacttctacattcgccacgctaaattacagcgagcaaagcaattattaattaatacccatcttcctataggtgaaattgcagaaagaatcaaattttttataaagaagaataaataggatatggtagattgtaaaatnnnnnnnnnnaaatttgcaatctaccatatttactttgtacaataaaatatttttttgtgttttaaaattcgcatataagtttaatcactcttaaacttgatattaattctgcaatatcaagcaagctcctaaccaaaccttgaacgcgctattaggttaaaaggcaaccaaagttcatatgagtaagacgagtatttgtccgctcgtcttatttatacaaatcacccaatcaatgtgactactatacaaacagtaagcgctcactttttccaaaaataattactaataagtcttattttaagtacaagcacggattatatctgatagcgcaaacaaccagcttgacacctattaccatcgagacttcatagcacctatcgtcttgatcatttccgaatcacgatcagtggtcattaatgattataaaaataaccctgttagcaccaaaagacgccaacagggttgtttttgtaattatctttaattgtaactgacactcaattaagcttcagcccgcttcaaatcagtatcagcatacattgtctttttagtttgcttgctagcatcttcattaacaaacttgtccataaactcttcaaccaagttcaaagtctgatattgtttagctaaactgaagctttgacgccattcccggttgcgttgaatcaattcagtaaagacttcatgttcaatccgagcgccttctggtgttaactttaaaactttgttacgacggtcatggtcttcagcttcttgatataagtaatctttccgtaataagcgaccaattaagcgtgagattgctgaacgcgtcacaccgtgactttcggcaatatccatcagacggatcttaccttttgcttcagcaatatcatataaaatgtaaaattcatccaaagtaatcccatgttccgttgcaggttcagcaaacatatctgataagtttttaaagccatgtaaatacatatggctaaagcgattaaaaaattccatatcttcattcattattcaagtctccctttcactagtcgaattatcattaaattcccaatcataattcgccccatacttttttcataaattagtaagcgtcgtttatcatttccccgctttaaagtgtactagtatattttacgaaatacaagtaatttagattactttaatattaaatttttatttcagtgctcaagtcaagggtcgcgtgtttatgcagatacgtgatgaattgctgataataatagtcagtattatacttggctgtgctcaaataaatttgatcaattttctcagtattctcacctaataacaagtaaaacgcttggtcgatattttctgcaatcatgccaacactagctcttagaattttacgcttgaaaaaaacagccataccaccagataacgcgaagttcaacgcgtatctaatcatagcagcttcaccttctacgccgatagcttctagccagtctagtgtcactagcaccatctcagtcgtcagttccggactctcgaagatgtcctgaataaagtgttccatggtcggattttcatctaacatccgcaaaacaaagctcatttgaatcattgttcgctgatacgaagacagcatggtcagcttttcattactatagataaaagcactaagcgtcaactcatttaacatcgtacttaataaaacgattttcttcgggaaatagtgttgtagcaacgacttactgatatcacaggcaatggcaatgtccttcatctgaacgttcgcatacccctgctcggcaaacaagcgaaacgctgtattaacaatctccattcgccgttgcgtgttccttcttcgtggcaagaaaggtgcctccctatcactgattttcaatcattctcttttaataaactatactaatatagctttgaacgcaagtgataatttaattggaaagttaattaataacagcctcaactatcaaaatgatcattacttatcaataaaatccgcgagtacttccaactacaagttagttaacaaccactgcggcttaacgtcttaatcgtctaaacgcactagcagctattcatcagccaaaaaagaaaacgctttcttatgtgaaagtttgtgctaaaattaacttatcaacttgcagggaggctacaatatgagcactaaaaattcttatcaattagccgatatcggtcgccataatccgatcttttcacagatccgttctaccgtcgaaacggccttttacggtaataatatgcaccacgttgatgatatcgctgccgcttaccaccgcgctactaaggaccccggaaccgttattacggacctcccaatctatcgcgcaacggatttaggcttaccagctgatgcaaaaatgttgattgccaatacgggtaaggttgttggccgaaccgcacaagcgcgccggattctaggcaacccgggcgttagcgaagccgatatggccggtcgcctacgccaagcactatttgctagtgctcacaaggacttcatcacgacggacgttctggtcggtttagacgaagacttcatcgtgcgggcccacctcgcgattccggacggctttgccaataatctactttcttacatgcttaacttccagcccatcaccactgcttatcaagaaatgttcgatcggtccgttgcctatccagaaggcgatatttacatttacgctgaccctacttaccatgatccagattatccagacggcctggctatttttgatccgcaacataatacggctgccattctaggaatgccatactttggtgagttgaagaaatcgactttgaccttagcttggtcgatcgcccatcgtcacggcttcgttgcttgtcacggtggcttgaaggccttccacttcaagaacaagcaagaccaagtcttcgccatgttcgggttatcaggttccggtaagtcaacactaacccacgctaaacacggctataaatacgatatcaccgttctccacgacgacgcctttgtcatcaatcgcaaggatggtagttccgtggccctcgagccttcttactttgacaaaaccaatgactatccgatgacgtccgatgagaccaagtattttatgacgatccaaaacgtcggcgtcaccttagacgatcagggtcgcaaggtccttgtcactgaagacctacgcaacggtaacggccggacgatcaagtcacggtacgcttcgactaaccgggttgataaggaagccgctcccatcaatgcaatcttctggattatgaaagatgatagcttaccacccgtgattaaagtagatgatcccgtattagcagcgacattcggcgccactttagcgaccaaacggagctcggccgaaaatattattggtaatgtcgaccgtaacgccctagtgatcgaaccatttgcaaacccatttagggtctatccactatcagaagattaccatgatttcaaggcactcttcgaagaacgccatttagattgttacctattgaatactggcttctttggcgataagaagattcctaaggaaattaccttgggtgcgctggaagccattgtcaatgatacgaccaagtgggagtcattcgcaggcttggagcacatgcaaaacctaaagttagctgatttcccagttgattatgccaatgcagactaccgtaacttggtcgccactcgtttaggaattcgggctaacttcattgatcaatatcaacacaacaatcatgaccagcttccccatgagattactgatattctagtccacctacaagatcaattaaaacaaccaattacaaaataggatggtattcgttccccgcttcagaccaattaaggttataataaaagtagcaggtatatggcactgaacttttacgaattctaaaaatcggggtgaggagcatggaactaccattaagtcaattatcagaaaagctcatcagttttgaacgcgagcaccatcttacagataacgaccttgcgtttggcagtcaattatcagttgaacggattcacaacattaaatctggtgaagcaacgccaactcaggaagaactgcaactgttgaagaaattcatgaatagcaaagccaaagcttaactgctagttcagcgataaagcctaattggggcaaagatcctcactaaaaactggtcgtccattcgaccagtttttttgttacctaccatccggattgcgttttaatttaccctgttatcacctcgtgctatactcggcacaacttataaagataagggtgaccaacatggcaatgttatacggtaaacacaatcatgaagctgaagaatacttggaaccagtctttggtgcgccttctgaacaacatgatcttcctaagtatcggttaccaaagcattcattatcccctcgagaagccgatcgcttagttcgtgatgaactattagatgaaggcaattcacgactgaacctggcaactttttgtcagacctatatggaacccgaagccgttgaattgatgaaggatacgctggctaagaatgccatcgataaatctgagtacccccgcacggccgagattgaaaatcggtgtgtgaacattattgccaatctgtggcacgcgcctgatgacgaacactttacgggtacctctacgattggctcctctgaagcttgtatgttaggcggtttagcaatgaaatttgcctggcgtaaacgcgctcaagcggcaggcttagatttgaatgcccatcgacctaaccttgttatttcggctggctatcaagcttgctgggaaaagttttgtgtctactgggacgttgacatgcacatggtcccaatggatgagcaacacatggcccttgacgttgaccacgtcttaaactacgtggacgaatacacaattggtatcgtcggtatcatgggcatcacttataccggtcaatatgacgacctagccgcactcgataaggtcgttactcactacaatcgtcagcattccaaattaccagtctacattcacgttgacgcagcgtcaggtggcttctataccccatttattgagccgcaactcatctggaacttccggttggctaacgtcgtttcgatcaacgcctccgggcacaagtacggtttagtttatcccggggtcggctgggtcgtttggcgtgatcgtcagtttttaccgccagaattagtcttcaaagttagttatttaggtggagagttgccgacaatggtgatcaacttctcacatagcgcagcccagctcattggacaatactataatttcattcgcttcggtatggacggttaccgcgagattcaaacaaagactcacgatgttgcccgctacctggcagccgctctggataaagttggtgagtttaagatgatcaataacggacaccaactccctctgatttgttaccaactagccccgcgcgaagatcgcgaatggaccctttatgatttatcggatcgcctattaatgaacggttggcaagtaccaacgtatcctttacctgctaacctggaacaacaagtcatccaacgaatcgtcgttcgggctgactttggcatgaatatggcccacgatttcatggatgacctgaccaaggctgtccatgacttaaaccaagcccacattgtctatcatcatgacgcggcacctaagaaatacggattcacacactaaatcatcacgttattttgaataaagtagccaaactccagaaaacaattaatatcgctcacgcatacaaaaatagcatcatcctaattctgacgaactaagatgatgctatttgtccatttaaggaacgttaattacatgtggatagcaaagcttggtgtatagtaagcagtgctcttaattgaaacagattcgccgtaagttggtgatgcgatgtattggccaccgcctaagtaaatcccaacgtggtaaggtgctgaatcagaaccccagaagaccaagtcgccagcttgtgcttggctgaatgatacgtgagtaccaatcgttgcttgggcataagtagtccgaccaattgaacgaccaaccttagcaaaggcagcttgcgtgaatgcagagcaatccatttgttcgtaaggtgtgccaatgaaagtcttgccagcagcaattactgaactgtatgatgcagttgaactagttgttgctgaagcacggtaggctgttgcagtagcagtcgttgttgatgaactgttcgttgttgtgttacttgcagttgagctagcttgtgaactcgttgaagtagcagctgattgcgtgctagtagacgatgctactgaagttgagctttgtgatgcttgtgaagctgaactttggctagcagagctttgtgaagttgctgaactagttacagcacttgaactagcttgtgaaactactgaactcgttgaagcacttgaagttacactgcttgcactagcagttgaagtactactcgattgcgcagctactgagctacttgatactgcttggctcgtactacttgcactagtagttgatgagctggttgcagcagcactagtagttgaactagcagcttgtgaactcgttgaagttgcagcactagtcgacttggcactgcttgcactagcagcggtcttcttagccgtaaccttttcaccggtcttaacaccaggaatattgatggtcttaccagcaataatcatattaggattgcttaaaccattagcttcagcaatcttgtcaacagaaacattgtacttttgtgcgtatgcccaaacagtgtcccctgctttgattgtcattgaatcggcattggcaactgcttgactagtaactaacataccagctaaagcagcagttcctaacatcacttgtttaatatttactttcactttaataatgatcactccaaaaagaatgtcacgtatgtacttcaagccaacgtctatactactcaatttgtgttacataccaataccagcaaaataacaatatgttacgaaagttacaaaaccgtaacaataattagccatcgtaacatttccgcgctgaaaccctatcataccggcatcgttttattactaaaatttgagaccatttagcaactttgacgaaaaaaagttatttttattttaaaaagccgaatttccagtgacaattcctggaaattcggttaaatttcaatttaattacgaccaaacgttcggttaatttggactatttagatattcgttggcgatgatgcgttcgcggtaatcctaatagccatcgaatatcattacccgtaaagttcaacttcaagaattcgccactttgtccctgttgatacatggtcggtaatacctggtcttgcaacttgatcacttgctgtgcgatctcttcgtcaaataaatattgccgtgtcgcagcagcaatttcaccaacagtaaaaatctgagcagcgttagcaaatatctgctctttgcccagcgccaactgggcttgtttaaactgggcgtaggactgatccaagacttggcctgcttgagtttccaatgcggttactgtggtcatgatgcgcacctcctaaatttatccctattgtaaccgccatcgctgactttgaccacgctaaaccatgctttttaaataaaatttgctatactaaaatgacaaaggggaaattaacttgacgaatacagacgatcgttattatcaaccaaccgacatcaaagatgcgcttcaaacaattcaaaaattatttaatacttatactgatgccccattaacacccgaattaatggcctaccatcagaaattagttaaccagttagctactaatttattaccactagcacaacaacaacacgacaaattacgtatcacccaaattaattcaatgatggccgtcatgcaagattggctaaaattaaggctgaatgggcaagttttcggcggcaaaatgcaacacttcaagtttgtcagcaaccaaaaagcacagtacaaacgacgagtgcataaaattcgtggtaatcaaaatcatcgtgctagccgccattgataacgaaactagacttgcacgactagcattttgcggtatactaaaagttgtattgggcccttagctcagttgggagagcgcctgcttcgcatgcaggaggtcgtcggttcaaatccggtagggtccatattaatagacgtcgaaaattaaggtgtgttgcaatcgaaattgattacaacacaccttattttttggaccatcatttacttgtgtttatcaaagtaacggtctgttgttttaacgaatggtagattgtaaaattannnnnnnnnngattaaatttgcaatctaccgaatgtactaaattatttttattgctggttacaaggtgctaaaagtatttgattttacatgatatcgctttttttattttaccttcaactatactccagctcgcaaccacgcactcgtttccttgtacaatcgctcaacttcttctggtcgatccgtccctaataagtcctgactaatttgaccaccggcagcttgtcggacataggccaggaattgatacgagggccgtaaaccgttaaaatcttgaggtatcacgtgtaaattctgtcccgcaatgactggtcgtaaattatcactttcgttaattgaggtcaatcgactaatcttccacttagtatcacggcgttcgacacggtaaatcagtcgccgatatgattctaattccgctaaagtaccattgaccatcatgcgcatatgcgtcgtagttggtagttccacgtatgccttattaccattcagatgaacgacaggcgtactgagccataaatgccagtcgttcatgctgggtgtcttgcataattgcaggactcggtaaattgtcacgcatgtactggcgtagcgctggactaactgttggtaacgcagcgttaccaacagcttgacgcattgcggcagtcacagctgccgattcaaaatgctcttcaacggtaattaatttcatcagtcgacaatctccttaattggtcagctatatctaactgtgacagctattatagacgctttcacatgctaaaaaagggacgttttgagacatatcacaagttggtgtatcattgacatatgacaaaattaattatgaacaatcaattgcatattgatcagcgaactcatcaaactcatcgtaaattgattactgccctgcaagcgaatttcaaggctcaaaagaccttcaacgagttgactgtcaaacaactttgtctggatgcccacgttggacgtgccactttttatcgtcatcaccaggatattgaagatatcatcgtgattgaatacttaattgccttacaacagttaggacaagcgttaaatgacttaacgaccacatcttacgcaaccattgctggtgtaatcgtcacgacgcttcgcgcacatctggatctccccttactcgtgtcatgggcacagtgtcgcgatcgggtcatcccattagaagttggttttgcccaacagctgctaactagcttagccatccatcctaagcaacggcattttatggcaacctatcttggcaactgtcttcaccagttagcttggcaactgtcttcaccagttagcttggcaacttgcgaccacgcagccaacactcagcagaattgagacttaccggctatttattcaattaattcctaatgtcttacaagcaccaacaattccaactgactaatccgtttagttattaatatacttgtaatagccgtctaaatgtctcaaactatcccttactaaaaacgatgaattacaagttacttagtaattacacagatatttaattacaattatccgcaattaggacagataaagtttcatttttgttaaattattagtgggtcctgtgagctatagctcacaggacccactaatacagtttcaaatttgaaactagctttgcgcttatttgataatcattattactcatgttttaataccacgttagtttggccgcctacccctgatgctggcgaatgtcgtcattatccacacccaccgtttgcctttatttgacgctaaccgtaccaccatgtacgctaacaatatcaaacaatttatggaggaaatataccatgcaaatcaatccaaatcgcgcccaagatgtctggaaagatgtcggtgaacacgttcaatttaccgttcttcaattaaatcgtcaggatcagcaacacgaccgtgaagtctttcaagaatttgcagatcggtcacaagccatcattcgctcgttacgcatccgagacgccaaacctgaaactggcacccaattaaaagttagcatcggcatcagtagtgccgcttgggattacctgtttcctggcgcacccaaacctaaagaattagaaacttacaccaccttaagtggacccaaatacactatgccagcaacacccggcgacctcttcttccacattcgcgcaagcaacgaagcggtcgtctacgaatgccaaacgcagttccagcgggttttagcgccaatcacgaccgtcctcgatgagacgaagggctttcgttacttcgagggccgggccatcattggctttatcgacggtacggaagcgccggccgtagaagatgccgctgattatgccttagttggtgacgaagatccccaattcatcaacggttcttacgcctttgcacagaaatggcaacatgatatgcccgtgtgggaacatatgcacaccgaggatcaggaaaaagccgtgggccgtgaaaaattcagcgacttcgagttagaagacgcagacaagtttaagaatgctcacaacgttgcttcaaaattggaaattgatggtgtcgaacaaaaaatcgttcggatgaatgtcccgtactccaatccagcagctggtaacacagggacgtacttcattggttatgcccgtcactggacggttaccaaaggcatgctgcaaaacatggtcgaccaaagtgactttttactaactttctccaccttactatccggacaagcgttcttcattccatcacgtgacctgttagctcaaattgcagatgatgatttttaagctattactagcgtactcgttttgacgttaaggcttcgattaggaacgcgctgtcaaaaaaggcagtcttgcttggtacttaataaataccaatcgagactgcctttatgttattttaactttagtttaacggtttattcacgaacaatattaacagcaacgaaatcaatatcgtagctttatattgattatcattccttttcacggtaactggcaactaacatctgctatagtagtaagtaaagcaactatcaggaggtatcatttatggcaaatcgctatttacataatgtccaaggtttgttcgacaccatcgcgccgaactatgatcggatgaataacatcatcagtctcggaacgcatcgtcattggcgcaagcaaacgatggcacaaatccatttagcgcctaacgcccatgttctcgacctctgttgtggtacgggtgattggacgatcgcgctggctaaagaattacaggcacccggcgaagtcatcggattagacttttcagccccaatgttaaaactggcacaacaaaaagtgacccagcaacaggttgccgatcgggtctggttgcgccgcggcaatgcgatgcatcttccgtttaaggacaacacctttgacctcgtcacgattggcttcggactccgcaacttgcctgataaagcccaagctttaactgaaatttatcgcgtactaaaaccgggggctcgcttggtctgcttagagacgtctcaacccgatcaaccattgattaaaccagtctggcagtggtatttcacaaaagtagtcccactattcgggcgcttattcgcccatcaatatcaggaatattcttatttacaggaaaccactcgtcactttgcaagctatcaacaattagcaacgatgtttcagcaagcaggctttcaaaatgttcacttccaacggttcaactttggggccgcagcggctcactttgggactaaggaggccaagtaattggacgaactgaccgctttcaatcaatgtctggcttggttgacacacaccaccgccttgcctgagcacctcgatggcctggtcctttgtggcaacagcctcccagcaacagccactgcagcgggccagttagcccaagactatcaattaccactactcattattgcgggcggtatcggccacgccactaagtatttgcggcaaaacttaaacctgccaaaatctcaagttagtgaggctgagttgatggcgacgcttgttcgaaagactggctatcaaggtagtatccgcctcgacaagacttctaccaataccggtagcaatgccacgcatgcccgcgcgttagcccccaccgattggcgccacgttctactcgtacaagacccgttactcgcgcggcggactaccctaacgttctcagccaattggcccaatgccaactttattcgctatgcgccggcgaccttgcaattaaaccggctacaaccaatgcactttacgccaaacacaatagtagctggctggcaacccgcttattttactgaactcttactcggtgaatttcaacgcctagtggatacccccaccggttatggtccccgtggtcagggcttcatcgcccatgtggatattcccgaagaagtgctcgctgcggcccggtatttacagtcgcaatcactacaccgccagcgttaacgtttattttaaaaatctagtagtgccaccaaaaaatcccgtttcactgcagcagaacattgctacagtaaaacgggatttttataagatgggttgatcacgatttaaaaacatctggatactgtgtccgcaacgcttgtgctgttaattcgcccgccatccgggagccagctaaatctaaatgcaccccgtccgtggtactgagttgccaagtagccgtttcaatgagttgcaattgcataaattcggccacgaccgcacgaataatcgctgcaaaattctgattaaacgggatcattacagcaagccggctattcgggtaaagcgtctgcacctgattaaggaagcggcgcaaaactaccgtgaacgtcgtatcatccgtatgccgatcattagtaccgacattaatcacaactaaatccgtgggtactggttgccacgtcgtttcactatccacggctgttaaaacctccggcagtaccggtacgccaccagttcctggtttactgagaccaacggcactataagcaatgcggacattccgtgcattcaacaagtcactcgcaaccgccgcatagttagcttccgcgcgataatcttcggcaggttgcttacccatgacccagcagccggccgtcagtgaatccccaatccacgtcacgctgtgtcggcctaactgaactggctgtaactcaccatctgtcgtcagggctttcactgcaaaaccttgattgccatcccacacacggtcctcatcagtattaccactcaaaactacccgtaccacgtggggccgaccatccagtgtcaaccatagggggtcattcgtcaccgcctgccgttgaaaaggcaagccatcaatctgaatcgccacccaactcggtagctcatacgccaacggcaagaatgtcaaccgcacaaaactagcatcagtgacttgaaaatcgatttcagcacccaaattagtgctatacatcacgtctcgatccgcaatttgcttgaccgcccaacgcccctgaaagtatgccggcatcaagggctgatttgcctgcgttatttgataatccacgtttttccctcctatacctcttgtttactcaaacttgatcatcctacctattcttccgttaacttgtcatgaaacatgattaaaacatgccatttagttggcttactgttcgtcagccggtgagcgttctattccgacctccggggctgggtgacaattgctggaacgcagccgacgtcgatttgagctaacgcataacccgcgtcatctcaaatacgagnnnnnnnnnncacttagcaagcgtcctttgcttggttagtgaaaggccagtatttaagacgtgttttttcggctcgaatctgtgcccaccacgttccggcaattggcagaaatgcctggaggtcggcgtaggacgaacgaactaagcaggtttacgctaacccgaactgtttccagtgggtctaagctggctgcttttgaatttaaaaaatggcatgttttaatcataatcactgccagcaatccagaattaatactgttattttgcaaaacttgacgcctatcaagttgccatcaagctgaactcactatactagggtcatcaaatcaaataaggagttgcaaattatgaaattccaattatttctcactaaacatacgaatcaaattacattagttacggggattctgattgtccttgggatgctcagtaaatatctcttacaatttacgctcggttaccaagtcattttagcagttgcttcaattattgccgtcattccgattgcggttcgtgcttggagcgcacttcggaacaaagttttcagtattgaactgttagttagtatcgcagtgattggggcattcattattggtgaattcaacgaatccgcaatcgttactttcctcttcttgtttggctcctatctcgaaagcaagaccttgcagaagacgcggaccgcaatcaaaggcttgactgacatgtcaccaactaccgcaactttagttactgatgatggcaccgaagaagtcgacgttgatgatgtggacgaaggtgacgttgtcctagttaaaaccgggagccaggttcccgttgacgggatcgtcgttgaaggtaacggttaccttaacgaagcctcaattacgggtgaagcacgccaaatcaacaagcaactcgatgattcggtttattcaggaacaatggttgaaaatggctatctgaagatcaaagcgactcaggttggcgacgacacgacttttgccaaaattattgaattggttgaagaagctcaagataccaagtccaaagctgaaaagttcatcgaccgctttgctcaatattatacgcctgccgtcctcgttttagcagtcttagtcttcgccttctcccgtgacttccgcttagcaatcacggtactggttctcggttgcccaggtgccttagttatcggcgccccagtgtcaaacgttgccggaatcgggaatggtgccaagcgcggcatcctgatcaagggtggtgaagtcgtcgatacttttgccaaagtcgataccctggtcttcgataagaccggtactttaacggaaggtaacactgccgttacaaccatgcacacttacacaaacaacgcggataatcaactagctctcgctgccgctattgagggcgtttccgaccatccgttaggccaagcaatcgtcagttatgccgaccagcagtcagcgggggtctctcccgtcctagatgacactgaaaccgttaagggtcaaggaatctgtgcacaagtcggtcaacaagaagttgtcattggtaatcaaaaaatgttgacggctcataatatcaaactaaatcctacccaactcaaagatctcaatggtttacaagctggtggtcaatcaaccgttatcatggcagtcgacggacaagttcaactcatcttcgggattgccgatacgattcgtccaggcgtgaaggattccctcgccgcattaaaagcccaaggaatcaagaaactcgttatgttaactggggacaatgaactcaccgctcaagccgttgccaacgaattgaacctagatgaagttcacgccaacctcttaccagaagaaaaagtcgaatacgttaagaaactaaaagcagccggtaacacggtcgcctttattggagatggcatcaacgacagtccttcaatcgctaacgccgatatcggaatcgcaatgggtagtgggactgacgttgccatcgacacatccgatgtcgtcttgatgcaatcaagcttccccgcattagtacacgcccacggtctcgccaagaagactgtcttgaacactcgtgaaaacatcttcatcgccattgccaccgtggccttcctactgattgggctaatcttcggttatatctacatggccagtgggatgtttgtccatgaagctagtatcttagtcgttatcttcaacgctatgcggttaatcaatttccaaaccaagttcgacaaacaccaaccaactaaaaccattcaagcagccacagcttaatcaagtctccccaacttggttacaggcctagcaaccaataacggtccgccgactagtcttccccagctagtcggcggaccgttttatcatattgcaatcaaaaatgatagaccaataataatttcataaatacgctcggttaattaattgcgattataaaccaaaaaagatcttataaatccaaattccaataacggcaccaacaattggggcaaccacgggaacccaactatattcccagtgagaactacccttgttcggtactggtaataacgcgtgtactagccgtggtcccaagtcacgggccggatttagggccggaccggttggacctcctaacgaaataaccatggcagcaatcaaaagtccaacgccaatattggcgatatcgatattttgatggaaaaacatcccgcgatatagccccatggcgccaaaaatcaggaccgcggttccaaccatttccgtaacaaaaccgtttaactgactgttcgcatgatcactagttgcaaacgtccctaagactgcctcattatcagtcgtttgccgataatggggccagtacagtgccaaaatcaagcattggcctgcaattgctcctagaaattgccagattaagtaaggcgcaacgtgcgcccagggaaagattccaatcacggcttgcccaatcgtaatcgcggggtttaaatggttaccagaaatcgagccaaacatcatggctgggagcatgacccccagtccatatcccgatgcaaccaggagccatcctccattggcgagtcctggatcatcgttaccagtcgtgttcttcaggaatgcgttagcgacagcgccattacctagtagtactaggatcagcgtgccaaaaaattcagcggcgtagcgtgcttcccatgaacctgtcatctgtaaatcctcctcgtaaggtaccgagcatctatgataatttgaagataccagataaaactgtttatgtaaacgctttatttcgcttaaataagcggtttctaataattcaacataattctaccagataccctgggttgtataattatgaagcgctagtataacacgctcgcgtcaacatgagatcttcaacgttaatgctcgcgatcacaactagaagattctcaggtgacgctagcttccacaacaaatcgttattatctaattacccaatacatcagtcctttttaaatccctccacggccagaagcagaatacttgctcgtgtatacctatgggggtatattgtttagtgacaaatacttactaaaggagtcaactaaaatgattaaagaaatacatgaccaagattttgccaaagaaacagatactggtatcgccgttattgattttcgcgcagactggtgcccaccatgtcgcatgatggacccaattcttaagtccctttctgaagacccagcttacaaggaccaggtcaacttcgtttcattgaatattgaccatgaccaagctacggccagtcaattccaagttcaaggaattccaaccttcctgattaagaaagatggccaagtcgtcagtcacatggtcggagcacgtcctaagcctgattttgaagccgaactcaaaaaagcacttgcttaattacgaagggggcatcatgaatcatggcaactactgaagaatatgtcactagcaagcagatcaagacccggctaaaacgctcggctggtcaactggacggcgttttgcgtatgatggacgaaaatcgtccttgcgaagatgtcttggttcagctttcagcagtgaaatcaagtatcgacaaggccatgaaactcgtcatcgcccgtaatattaataattgtgtagatgcgatgaccacggctgatgttcagaatcttgaacactccttggatctactgctaaaaaccaaataacgccaaaaaagacggtgtcgccaatctcagttggttataccgtctttttagtgccagttgactcagttaagcaccgtatctgtcaggcaacttatcgagtcaatctttccaatctccctttttccagtcatcatggttccaatcatcttttttccagtcatcgtcgtcatcactgtgggactgctcggcatccttgggcgctcgttttgctcgcttcaacagtaccgccgttgaaatcaccgttacgaacccagtcgcaataataaagacaaatgtccacatcacaatgtcgctaatcgccatctcgggtccctcccatataatttaattgtcgttagtatagcgcaggcccgttgtaatagcaaaaacgccctggatagtttgcccacacaatcgctatccagagcgtttaattcttcagcgacaacgacctaatcgtcgtcatcctcatcttcttcatccaaaccagttcgagcatcgttaccaagataagcttgtaattcccgaatattgcgattgttactgccacgataagcaactaaccaagctgccagtgccggccggttttctttttcagcaagcttgatagcccggtcaacgaataggttttccgtatcaaaatccttgattgttgcggccacgagttcatcaacagattgatacttgaaagccccattttcttccaacatggaatacttggttaattcagccgttgtggaagatggcttctggttttcatctaggagtaattcgcctaattcagcaaactgacggacattctgatctaacaaacgttgatatgctgtccgcaatgccaatgattgtggtcctttaacgtaccacttcacttgggtcaacttaacgtaagcaaccattaagttagataaaatgtgattcgtcattgcgcccgctgttgggacatggtgatcaatgtcactctgttttaattccgctgcgtattgttcgtcgatcgttagttcactcatcgtttattcctcctacttaaccttgacgttttcaacttcgtaaccaagtccggtaacaacttgtgccaaatcatcggcattcgtcacttcaggatcaaagttagccttgaccttgctggcattgaatagcaccttaacattctcaacgccgtcatggttagcaacggccttttcgatcttggtcatgcatgatgggcaagtcaacgttcctaattgcataataattttcataatcaattacctccgtgtcgttcatttgatggttctatcataaccggatttgattgaccagaacttgacggccgtcaagaaattcaaaaaagttttacgctacaatatagttattaaaacagtaggaaatttaaaacgtcaaaccctatctaccaagcaaaatctgttatagttagggtgaatttattcaggaggtgggccttatggcagaacatgaatgtgtgcagttagtcccaatttttagcgaactcggtagtgaacaattagacactatcgaatcgatcgttcgtcaccaccactatccagccggcagcactttatttggtgctgacgatccactggattcactgatgattgttgccaatgggcaggttaaagtctatcagctagctgccaatggtcgcgagcagttactatacctattacaaactggtgatatcgatggcgaagctgccttatttgaaaatcaacggcgaacctcattcggtgaagccttagtaccgacggatgtttgcagtattcgccgttcagactttcaagacttgatgcaaaaatatcccagtatcagcatcaacgtcttaaacgtctttggcaaacgtctcagtcaactggaacgtcaaacaaccagcacggccactgaatccgtcgaagcccgtttagcgaactatatcactgaaacagcggcagcgctcaaaaccgacacgtttaaactaccattaaagaaaaaggacctggcgacgttcctcggcaccacccctgaaagcatcagccgtaagctcgccttattcgagcgtcaaggcctaattacgcaaaagcctggcaaggtcatcgaaattaacgatgccgaccagctattattaactgaataatgactactaattaaattatccctaattccccggatgactagcgaaatcaccgttagtcatccggggaattttacgtcaaccatcacactgcctcataaggtgatttacaggcactaacagctcctgcatgccgataattcagaagtaatctcgccctttacattaacattcacaacccatccgctactgattcgggactattaagatgattagtatcattttttactgagtcggtaccagatgataccactgagaataatctaaggtataattaacttagtattagaaaatttattagggagtggatttaatggcaaccattaatcaagcagcagtaaaacaagatctctacgatgccgtcaacggcgagtggctcaaaaccgccgtcattccggatgaccattcttcaaccgggggctttatggacttagttgatgccattgaaaaaacgttaatgcatgactttgatgcaatggcggcgggaacaattacccccgacgatcctcagctaaccgaattcattaagttttaccgcttagctaaagatttcgaccaacgcaatgccaatggtgcggaaccaattctgccgtgtctcaagcaaattgatagtttaagcgactttgctgacttacaacaacggatgcccgattggatctacgacggcctcccattaccattcagcttggatgtcgacgctgatatgaaaaataccaaggtcaacgccttatttgcccaagcacctgggactatcttgcccgacaagacatactacgacgaaggcaaccaggccggccctaagttactagcaatttacgctaaaatgatgaccgaactgttgcaaaaaactggttacgaaaaggacgaagcacaaaaaatcgttgatgacacgctgcaattcgatcgtttgatcgttccatggatcaaatccgctgaagagtcggctgattacagtaagatgtataatcctcgcaaattcaacgattttgttaacactagtcgttatttagacttagccgccatcacctactccgtcatcgatggtaatcccgacctcgtcatcttgccagaacccgccttcttcgatcactttaacgaagtagtcaatcctgataacttcggtctgatgaagaactggatgaaagctaaactcgttcaacggtacagtggttacctcagtgatgaaatgcgggtattagccacgacttattcacgggcattgtctggtcaaaaagaaccgcggaaccaggctaagagtgcctactatctagctaccggaacttttgatcaagtcgttggactctattacggccacaagtattttggtgaagcggccaaagcggacgttcatcagatggtcgaaaagatgattgccgtctacaaacgccgattgcaagcgaacacttggctcagtgcagatacgcgtgctaaagccgtgaccaagcttgataaactcggcattcaagtcggttaccctgataaactagaaacgatttacacgaaattcaagacgcacacgcccgaacaaggtggcaacgtattgagcaatgtcctccactttaaccgtttggcacgccaagacatgttctcaaagtggggcaaagccactgatcggacccgttgggaaatgagtgcggacaccgtcaatgcttactaccacccatttatgaacattattgtctttccagctgctatcctacaagcacctttctacagcttagaacaatcttctagcgctaactatggtggtattggtgcagttattgctcatgaaatctcgcacgcttttgacaacaatggtgccctatttgatgaattcggtaacttgcataattggtggaccgaggaagattctgcccacttcaaggaacttgccaagtccatgatcagtgaattcgatggcttggactttgctggtgcgaaagttaacgggacgttgaccgtatccgaaaacatcgccgatgcgggaggcttaagttgcgcggaagaagctgctaagggcgaagatgacgttgatttgagtgcgttcttcactaactgggccatggtttggcgtatgaaggccacgactgaatacatgcaactcttactttcaatcgacgtccacgctccagctaagctccgagcaaacgtacaatctaagaacttagatgatttctacacaaccttcgacattcaacccgatgatgccatgtatttggcaccagataagcgggtcaaaatctggtaaaaagctttaatcaatgaacactaagaccgactaacaagcggtgcgattgcttgttagtcggtcttttatctgttccatcattatgggtcttattcattcaaattacgcgttagtatattacaatagaactgttgtctgatgccgttacatcgttattggactgtgacccagtctcaatcacgactgcaccgcaaatcacaccagcagacgcgttattagtcgacctaacgccattttcagcgggggtcatcaacaaggcaatcccagtccacttgacgcttaaatcagcatatttggacactggtaaccatcgaaaacaactagcattaactatgattaaaacgtgccatttagttggcttactgttcgtcagccggtgagtgtcctattccgacctccggnnnnnnnnnngccacttaacttggtacaatttgtcgttggctattttgatattggaactttaggtgaaatatcagagtgccttcttcactttgccaaaacgttcagttgttactacggcgattcagaataacgagctatcacaatatcatttttagcctaacagttgattgacaaaattactgtttataagaaacaacgacaaagccatcaaaaactgagtacgcacatgtccgccattcgaatactgtcccgactggaaggcgtttcggccaatgctcagcactgcaagagtgtgaggttcagacggggtgagactgaggattagcctagctagggcgttaagcggtgaatttccgcttgacgtcatagcatagctaaccggaagtctcagtctgacccgagcacgtttcaccaatatggcattaaagcgtggaagaccagtatttaagacgtggtcttcggcttaaatctgtgtccaccgcgttccagcaattggcagaaatgcctggaagtcggcgtaggacgaactaactaagcaagtttacgctaactcgaactgtttccagcgaacctaaactggctgattttgaactcaaaaaatggcacgttttaatcatgattcataacagtttaactagtacaataggaattactaaatattcatgacgcattttaaaggaggcactatgtcacaatttgaaaagtatcatcccattctaacgccacactatacgttcgattggttaacaaaggtgcgcgttatcgacgttttcaacttatatcagaccagcaatgcgacagccactatggaaacaaccgctgcacaaattaaccacaccatgcgcgagatttttcatgaccaccagcttgtttggggcgtaacggatcgagacacgaacgcgttcgtcggtcaggtcggctttgccccaatcgatacggctaagcatgaagcaactctcagtgttgacctgactgctacttatcagcaagtaactacgctcagggaaatcttagaacggttggtggcatttggtaccgttgagttaaagttgaaccgactcacattgattttaccaaagcacgatgacctaatggcacaaatactggctggcattaactttagtaccaccgaccacttaacattcaattatcaccaataaacaaataacgcgatgctaccttcatgaagcaaggtaagcatcgcgttattttaacttattattcagtgacagcttcggccgcatgggcaatcgctgcttgaccaagtaagttcaaatagttaaatggccggtcgtaaattggttggaagaacatatctacgaaccctaagtcgtcaatggtattgtgattttgaatcatcactgaaatcacattggctgattgtgaaacatcatgttcactcatgaattgtgcacctaggatttcgcgagtttcaggattgtaaaccaattgcattaaaacaggcttagtggttggcataaattctggccggtagttgtcttcaaaagtgacagcggctgccggaacattttcggcctgtgcatgttctagggtcatcccagatgaaacgatggtttggccgaacaacattaacccagaagttgattgtgtccccatgtacttccgcgttggcttgaagatgttcaaaccaactaaggttccttggcgaaccgcattcgttgctaatgggatataagcatctttcttagttggattatagtgaacagcaaccgagtcaccagcaccgtaaatgtctggatcagaagtttgcatgtagtcattggtcttgatcgagccattagcgttcatatcgaccttacccttgagtaagccggtatttggccggaagccaacacaaagaatcgccatgtcggctgtgtagctgcccttgtcagtcttgaccgtaacttctttaccatcatcactgaagccttgcaccatttgattcaaagccatcttgataccgtgatcaacaaagtcttgttcaacccggtcagtgaattctttgtctaagtatttatttaaaatccgtggtaaaccatcaattagtgtgacttccttaccttgcttctggtaagcttcaactaattcagtaccgatataaccgccaccgatcacaatgacccgcttagctggtttggctgcttcccataaattctgagcgtgcgtccagttcttgcataagtagacattgggactatcgatgccgtcaattggtggaataacaggccatgaaccagtagtgacaactaacttgtcatagtgatcagtcttagattcaccagtctttaagtcagtaaccgtaatttcatgtttgtcagtattcacatccgtcacatcatgttgcatatgaacagttgcgcctaacttagctaactgttcaggactggaataaaataggccttgaggatcagcaacttggccgccaaggtaaagtgcgatcccacaggataggaacgagacattgtcatttctttcataaatcgtcacttcagtatctggatttgatgctaaaatctgattaacggcagcagtgccggcatgggtacaaccaattacaataactttcatttttaaatcgctccttaaatgtgtttatattcacaatcatgcttgtgcaacatgtatttggtaacaattacattgtactaaagtaaaaggaaaacgcaaccaaaaacacgtaaaaagtgtaaatacttcactaatcacacgataaacaaatgccttgattacaacgttctcagtcattcaggctgattattcattcacttaactgtggtaattaaaattattattatctttaaccattatggctaataactagaaagcaaaagcactcacaatcttgcgtgtgagtgcttttgattctcttataccaacccgatcattacttaggtgcatctgttaacgtccacgtaatatcccccgtgtaagaacccggagtagctcccgcattgctttgatataaaatgcctgacttattcgtccagtctgccaagacatcataatcatcgttatcactagtagccgtgtgactgtcaatcaccgtacccgcagaattcagcgtggtcgtctgctcgccgtcgcggaaaatcacgtcgcccgccaaattctgaccaccggttgttttaaaattagtcgcactagcttgtagttgccaactagagcccttaccacgactatcccgtacaactagttgccaatcgtcttcccggtctgtcgtttgagccgaaccatctaaagtaatggttttaaacgtgctgcttttggcaaccgtcttaaaaccaagttcacctgcagtaacaataatctgcgctttatcaactggtgagacgttctcgtaacggtcagatgcccatagttcaatctcattgtcatcaccgacgtgtaaatcctctgctttgaccttgtagtagaagtaaccttgttcgtcatcatccgacatttgaaccgttggcatttccttgccattaagcgttgggtgtagtgtcacttgaccgttagttaattgttccgaatcctcggctgcaacaatccctctgatgatcacgtcttccccattggcgacagtatacggactattacgaattttaaggtatagcggctgatcgactgtaatcatataatccggtgcttccgtcgttgtttcaaacaccttatttttaaatgtcgccgtcgttgcagttgtctgttcattgacaacgacattctcggccgtcccattgagcgtgatcgtcgcggtcggttgactagccgatactgctttatctagagtatagtcaactttagtatcactactcgttggcgccgtcaaagtctgctcactaccatccgcatacgttaccttggcactgtcaaacgtaatatgctgtggtagattgagttcagccgtaatgttatcccagtcaatttgaccaccttggtaagtcaattgatagtcgtactgaactttatgctgagctttgagctggccgcctgtcttgatttcacgattcttggtcttatccgtaaccttaaccgccgcctgtacgtcaactaaattcggcgcgctttcaatcacgaccatgttattaccagaattactaccagtcgcccccatgaatccccagcgaaccaggccatcactactgttgaattggctagtatctaacacttcactctgagtaaagccgctacccgtcgccgacccatctggattgatgtcattataagtgtacgtcatcgttttagtcgccgcatgccagtccatcaccaggtggtgccacttgctatctcctaatgacatattcgtcactaggttggtatgtttttgcgtaaagtagtaccgggttgaccaaattatcccggtaacgtctaaactcctgacagactgattttcatactgactagccagcccaggatacccggtcgcaatgtgttgtttcttaataccatcatcaaacgaatcacccttaccagcattactatagctagttgaagtattggtataggtatcaaactctaaggcccaactattttggatgaccattttcgcaaattcttcgccgtccttcaatttattatccgtatcaacaccccaaacaccgagtgtctcaccaataatgctggacgaactgacttgtgcggatgcggcagtaccatttggatcattttgtaagacaaaagccatcccatcgccggccttactagtactcgtggatgttcccaaatacacccacattttaaacgtagcatctttatttaaatctaggcgattggcgtcgttcgaccaaaagccacccacttgcttcttgccgttaataacctgaacggcctgcgtatttggcgagcttgcattggtcacattcccaatattcgcactattactaatgccactactgaatgccgctggtagcgtaaagagtttatccaactgattcaggccagacggtgccgttgccaacgtcgcttcgtcagcagcctgaatttgggcggtcccggcccataatcccattaatgcagttaatgcaactagtatttgtttcggtcccttccacatgttgaaaactcctctcgctagttagtcctgacgacggcggtttttcaatagtagccagataattgcgcctaataggacaacaatcagtgcgcccaacgcaacaaaccaccagaaatagttcgattgtttttctgtaacagctgtatcatttaaagtctgagcttctttatcagtaatggtaaagttctttgtaaattgccacttacccttatcagccgttgccgttaaatgtaaagtgtacttgcccgccttcaattgttgcgtcccgtcaccaactgcaaagtcaaaattactattcggcgccattgacatgttttccttagtcgtcgtcaataattttctagacgaaccagctttagtcacgtagcttttgatctttaagccatgcataataacgggctggttgttttgcagattagccgtaacgtaattacgatagttacgttgcttggcttttactgcgtgcaacttcatcacaggtttgattccgcttggatcagattcacgtaactgcaagccaatcacgtacgcatattgattattgatggccatgccactactagattgtttcgccttggtactgagttcctggatgatattgattccacccagcgccacgcccgcaaactttttctcgggtaccgtcaatttaatagtgacttttttgcttgacttagcgggaacggtcacgacctgtgactttgaaagtgctgtcttgatgttaaacttcaaggagtcatcggccttagcctttgcttggctgtaatcgatgataccgttattatttgtaaccgccagattaggtgataccgtgtatcgatgttctttactatcactatttttaatggttaaagtgagattttgcgtttgccctggtgtgaccttcaagtcaaaataggacactttttgattaatttggttatcaggcaaatcagcctggaccgtgtaattgaggtcatccgctctagcagtcattgtcaaacctgccataacgatgctcacaacggcaattaactgccaaaatatttttttcataggctttacccttcctttattcaacggtaagtgacgagctatgtatgattgaagctgccattctttacaagtagcagcttcacatcaaaccatttaattaactaggtgcgttcgttaatgaccaagccagcgtacccgtgtagtcgccagcacgcaattggcgatcatggacttcaagttccgtgggtacctgcccgcgattcagaacgaccagccaagtacctagaccagtattaggcggggcaatcacgacattattcgctaaaccagcaactaattcaccagtattaacaacgttaggtgcagtactaacattgccagcaccgggccgtaattggactgcgcctaattttaaagacgtcgttaaggtctgctgaccactttgcaacccgcttggcgtgacctgtaacgtccatccagcagccgtggcgcggcgatcagttatttgaatcatcgcccgctcattcttggcagtcgtcttaaacggcccacccgcggtcgtaattgcattgaatttcaaattactgacgaaatcaatggttaactttccccgtgagcccgtaccagcgacattgtcttcatcgaccgggtcacccgggtatggtttactgggatcatcagggtcgaccggagaaactgcattgtcatcatccgagggggtcatttctacctgcacctgtgactgtgtcgttgcagcttgcgttgcgataaaccagccccagttactaatgatgagacaacctatcacagtcattaataaccgacctgttaccaacaatccctttttcatcggtcacacctcagttctcctctggcgcattaactggttagctaggggcgttacctaatgtccatgtcaaggttgaagtgtaagcgccagccgcgttaccagcagggatcaacaggctaacttcattggttgcatacttactcgtaaacttaccgatcccttcattagcttctgcgtccatgataatttgattttggtcagtgatatccactttataagcttttgctttagagatgttattagcatcatccgcagttgcattaacttgtgcaaaagttaacgcggcgccccgtaattcacgagtatcatctgcattcatgaacttcgaacctttaacttgtactaaccatccgtccgtattcccagggttggtcactttcaagtcgccagtaacgttcttagcatcataggttttactgtcattagtgattttttcggtcccaaagctaacaccaggtgcttgatccaaggtaatatctttattagtgtcatcctggattaattcaacttcagctttggtcgttgtctccgtatctgcagcttggccaacaagtggtaatcctgccattagtgtcatgcctgcaacgagagttccgagatattttttcattttggttgctcctttattgtttgacggttgcgccaccagattagaattaataatattaataaactaagtccacatacgccgataccgaacagaatccattgctgggtcccattcatttgcggtaatacaccttgtagcgggctcgcaattttatcggccgccgcattgccacctgaattagaagtgatcgttaagtggtaagtgcctgattgcgtatcagctactagtggtaacttgactagctgactaatacctaagtcttgaaagctgcccatccaattaatatgaccacatcctttccagatattgacttaagcttagtatcattattaacgcttagtaccaatagtgaatcgttgtgagtaaccctatcagcaacgaaaatatatcatggttttggaatcgctgtcaattgatgacaccccttaactattgattaaaattcctattttaacggacttctgagccatttttaatattatagtgattacaaatattttaatataaactactgtaatcagtttaacggcaagctttcctactgctttcatttatccgattaggtccaactagttggcgtgttcaactaaacaagccgtcaacattatattatcgttagactttgatgaggccacacataagttaaaaattttgataattataaatattgaaatcctatatatatttagaatatcgttgtaacagcaagctattacataaattatcttcaatttataaaattatgtaatcgatttaatgtggaaatcttttatcaattttaaagtgcaacacaatcaactaattaaaatcggctttaaaaacagtaaaagccccctaatcaaataatttcaaacgttaatattcatttaccaaacaatgaagtgtgctgtggtatacttaaaacacttatttttaaccagaaaggcggttcgaatcatgcccgctaaaaagacatttcaagacgatcaagttatcgaaaaaatcatgcacttattttggcagcaaggctattatcatacttccatggacgaaatcgtaataactagtggcgtcaagaagcaaagtttatataacgctatcggggacaagcacacactttacctgcgtgcactccagcgctatcaccaacaaactttaatgcgttgtacccaagcaatgcaacgcttagagcaggatggtgccgcccccttagctatcctgagtatactctttagccacgatttaacgacatccgaacaaacagccggtgacctaatggctaacgccgtcgctgaatttggtactactgatactgatgttcagcaagccgtcagctggttttatgacgactacctgaccctcatggctgcggtcatcctcaaaggtcaagctaacgagcaaattatcaataatcagtccagtatgacattagctcaggcactgctagaagcccgcattggccttcaaacgcgactccgtcaaggcagtcagccagatattcaagcgcagcaacaagcctggatggcttttctagcacgtcgttgaacctaaagcagttaatcagcgcataaaataagcaagcttctcccgaacattttgggaaaagcttgctttattttttcatctatatataagtcacagtcatacttttgggtcataactagcgattgacttataaatatttttgcactaaccagtgctgtgctgagctcgtcaattgactaccataatgttgtcgcaaccgttgcacacccgcgtaatggtcaaattcaaattgacttgtcagcgtctcactagctagcaacgccttagcaaactgtaaatcgtcaatcgtaatctgttgtcggtaagccaaatcttcatcggctatgattcgttgccactgatccgttaagatggcactggcccgctgataacgacggtcatgggtcaacaaggattgcatatcatctggattaagtggtgtccccatattattcatcctccaagttcaaattaactacatgaccgattgctggctcaatcgacaatcgatcttcagcccgcgctaacaaccaaatcacatttgtaaaacggtgtgactcgacgtgccgttcaccacggccatccgttaagatcagcgccaaggtcgtcgcattcgtcttatgatgtgttagtaaatcatcaaaaatactttgataaacggttccaccaccgccacggcgcgtaaagcgaatctgctgtggcaaactcacctgatacgtttgaccaggctgtacgattgcatcaaacggcttaacggtgatggttgctgcaaataatcgggttaaagtagccacctgtgccagtaatcgttgcagcatcagatcactgatagaacctgaattatcaacataaacttgcaagtccaagcgcgtatcgccaatttgaccgggtatttccatccgcgcgggttgccgtcgattaaagcgcgcgtgcgaggccttagtaccgctcggaatctgacccaggccccgaactagtaattgtcgccaatcaagctgggccggctgcgtcattacagtgagctgagctcgaacattgccggccactaaccctcggccagcttcatttgtttgctgccaagcatctttcgccaactgttttaaacgggcagttgccaaattgggattcgttaactgttcagaggctgaccagccacttggatcatcgatcaactgttgcgacttttggtcgccagacccttttgctggctgccgctggtccttatttcgcgaagtggcggtgggcgcgccattcggctgaagttgcgaccgcgactgctgctgtaataatttcaaataacagccagaatctgctcgtcgcggtagctgggcatcgactaacggctggacagtcgttaaactgaccgcatctttaggcagaccgtcgacatattggttaacggccaggtcggtcgccaacgtcactaactccggttgctgcttgacctgatcacgataccgaacggggtgttgccagacaatgtgtagtgccacgtgttttaaccccgcttgtaagtaagaaaactgtgaaaaagctcgagcaattactgttggcgcatattgtaagaccaactgattattctgccaagctaagataaacggcgtcgttaacgtcgtatttaactgtctgggaagtcgggtcagcaactcgccataaaattgatcggtggctagtaactcaataatggcccgatcaatcatggtcgcacctgcctggatcgtgtctgctgttggcgtcactaacatcgcttgttgccaacgtgtgtactcattggcattgttaatcatgatgactcactgctttcttactgatttgaccaactggcgacctgttgtaaatactgatacaaagcggtcacatacggactttgcttggcaacatttgctgtatataattgctttaataagtcgcgttcatggccgatttgttgaaccaatgcaaactgaccatcttgaccgagtgtttgtaggagttgcatgaaccgaccagcgtgctgatcgtccgtcaacggatacgtggttgttagagccaaacagcttgccaaaaccgttcgcttttgaatttcattcatcgccgtaaactgcttaagaatcagtgccggcaccacggcccccactggttgactgtcataaatcatcgctggtgtcagatgaatggcttgttgttccaagaattgctcgaatacaagccctagctcagtacccacatctccttgaaagatatccagtgccacagccgtttgttgatgcacaggaagtttttcaatctcatataaattagccgaaacacgcgcccacgcacgtggcgtcgctgttaaatcagcctggacatcagcctgattaagccgcgttacatcttcactaataaactgctggacgagtggatgaatgtttggtcggttcatgtgctcatccacttgtttggcccaagcaagccagtctgccgcatctgctcgcataactagacgcacggtacgatctttgatggccgcatcgccggcagtaacgccatacgtactactttcgaatccagtcatactagcatctggattttcagcaatgatcaattgcacctgttctggcaatttcaatgtgttaatcgtccgttgcaagaccagattcatcaattcactttgaacagcctgcgtcccacgattaaattcgtctaaaaaccacagaattggctgctgaggatgctgctcagcatactgaataatttcaatcaacgtgtgtgcatagccgaattgcacgtcagccaactggccatagcgcttcgtttgaataaatgagtcgctcgttagtggtgggactgggatcgctaaatcccccttttcggacaggctcacaacggtcgtgtataattgcgcccccatccgcttagcaacctcggctaccaaggccgactttccaatcccggcttcaccgacaatgttcggtacgttccccgcttttaaaacgaccggaactgctgttaatagagcttgatatgataacgccattaattaaaccttcctttactgttccacgtgaaacaaatttaattcgttttcaaaaacatcagcttacttgtcctaaccattataaaacagaagccaccattatcgacaattagcgttcacagtcacgttagatcacacaccaatcatactgactactatcaatagtgactatgcaaaaataaaatttttatttattatagttttaacaatccacaactgccataaaacgtttttataccaacgttttaccagtatcttatcaattaatataattataaaaatcttatcagaaatattcacaaatcaaacaaattccgtcgttttcacgagcaggtattgtaaaataggttaagttagcaattattcaaaaagagagtgtgcaactatgcgcaagtatctcgccgaatttctcggcacatttatgttagttttcttagggactgcaaccgttgtgattgctaagggtgacgtcctcgctattgggttagccttcgggttagcgattaccgtttcggcctatgcctttggtggtatttctggtggtcactttaaccccgccgttacgactgcgatgttaatcaaccgtcgaatcgatgccgccgatgccattggctatatcatcgcccaaatcattggggccatcgttgcttccgcagcagttaagtcgtttgtcagtgcattaggcttatccgcaacatcgcttggtcaaaccgattttccaaaaatcggcagtggtatggccttctttgtagaagcactagtcacattcttattcttaatggttattctgaacgttactagtaatgaccatggtaacgcagactttgctggtttgaccattggggtgaccttagcattcttgattattgtcgctctcaacttaacgggcggttctttgaaccctgcccgttcaatcggccccgctatttttgctggtggtagcgccttatcacatctatgggtctacatcttagcaccagaagtcggcgccatcttggccgcattctgtgctcgggttatgggatcagaagactagttagcaattgacagtcgtaccattaaccacgatcaatttgatactgaaacatgattaataaaacagcggtaccgtgatgattttatggcttggaatcatcacggtaccgctgtttttcgtatgcttatattttaggcagtctcaattagacgaatctacgttgccaacttctcatgacgcatggccctatagcctaaccctacgccaagttttacttgcgtcgccaatgcgtgtaccaggaatggagcgttccaatcaataggccaataatgacgacaactgctgaaacatagccaaaaataccaatgtttgtaatccaactattatcaggatggctttgaactagtagtgatgatccaacaatcagcgctgccagaataacggacagtacaatcttattgaccatcgaatcaatccgatcaataaacatcttgcggtgtgcaaagaccaagttgacccgcgtctgaccattctcaaacgtatctagagctgataataagcgtgacggaaccttcggggcatcacgcaggctttgaaggctagccaacatgccatcttccagttcattgcgccaattaaaattctcgcggatgtacttgcgcgcaaacggccgcgccacgtccatcattgataaggtcgggtcgagcgtctccacaataccttcgatcgttccaaacgccttacctaacatggtaaccgctggattcatttgaatattattactgcgacaaaccttgaccatttcaaacaacaagccttgaaaatcaatgtcgcccagtcccgaattataatactgacttaaaaatggtgctagctcactaaagaacgcttcttcatcaaccacgccagttcggtttgaaatcgctaagattgctttgccgacttgatgtgtatcttcggttgtcactgccacgacaacattagcaattcccgccatcaaagctggactgatctcacccatcatgccaaaatccagataaactaaacggtatggtggtagctgccgtttgccaatcttcccgccatgcttgggaaccgtatcgtgatacccaatatcatctggttgcaattcccgcaataagatattccctggatgaggatcagcgtgaaaaaagccatcttcaaaaacctgcttcaagaaattttgcaccaagacatgggccaaatagcggcgttcgtcatcatactggtgatttccgtcttcatcggccgcaagcatttgcgccataaaatgctgaatcgtcgttcccggcatatactggttaacaagcactttttgcgtactatacttcgcataaacccggggcacccgaataatatcgtccgcattattcagtcggtaaaaccgtgatccattttttacctcaatactggtatccaattcattgaatagtgaccgtttgatttcaccaaccatttcgcgcaaatcaacaactgaagactccggaatatatcgcaataggggtaacgcccgctcaaataacgaaatatctagggccacctcggcgtcaatacccggatgctgcaccttcaccacgaccttctgcccattgagcagtgtcgcatggtgcgtctggcccattgatgctgatgcaaacggtcgctcgtcaaactgggcaaacatttcattgattggcttccctgtctgctgctcgatcgtttgcttgaccacactaaaatcatcggcccggacattattttgcaattttttgaattcgttagcaaattctggcttaacgatatctgtacgtgaagaaagaatctggccaattttaataaacgtcggtccaagttcttcaaacgccgcgcgcacttgatcaggatttttctgacgtgcaaggttgctcaaaacgttatagcgccgcaagacactgacaatcgtccgaaaacgggtatggcggttctgattcacttgccattggggcttttcctcattgttgttggtcatcagcggaccctcctcacaaatttccttattacagctattatccatctttatttaagaatccgcactagctaactaactttttttgaaaaaagattgacaaatactaatcgcggttgtaaattagaaccacattaaaaatcgattaacaaacacgccgatgaacaaagtaaaccttctggaaatgcctagagagtgtcagtttggtgcaatgacatcatgaccagatcgttgaaaatcagttctgagtggcagtgacgagcttgatgttagttgctgttggttgctcccattattgagccgaagtatcgcaagtggccggccacttgccgtactttttaaggtgattcgtcgtaaggcagtcacaaagctaaggtggtaacacgtgttcaaacgtcctggtttctgagtctaactcagatatcaggacgttttttggttaatcgcaacttttatttaatgattattgtctcaatcaaataagggagtgctgttgatatgttaaatcgagttcaaaagcgaaacttaaccaaacgtgattacgtcaccttaagttcaatgattttcgccttattcttcggggctggcaacctcatttttccacttcacttgggtcaactagcgggcggtcactgggggattgctgcggccggctttctcatcacggcggttttgttgcccttactatctgttttagccgtctgtgtcactaaatccaagggagtttatgacattggtaagccactaggcgcaacctttgccgttgtcttcatggttctcatccactttacaattggccccttctttggaacaccacggacggccaccgtatcattcaccgttggtctggcaccgtttttcccagcaaagtatcaatcactcgcattactgctgttttccgccgcatttttcggactcgcctactacttgtccgttgaacagagcaaaattatggctcgggtcggcaaattattaaatccattatttttgctattattagtcgccatcttcgccgtagctttcagcagtccgctagctcatgccggtagcaccagtgcaactgctgcctatcagaccgcaggctttaccaatggtttcttgcaaggctacaacacgatggacgccttagctgggttggcgttaggcgtcactatcgtcactgccgttaacttcatgggtcaaaccgacccgaacaaagccgcgtgggtgaccgcccgagctggcttcttctcaatggcctttgaaggcttgatctacgtgctcttaatcttgttaggcgcgcaatcgttaggtcaatttaaattatccgataacggcggggtcgcctttgaccaaatcgttaaccactacatgggtagtgtcggacaagccattttagccgtgttgatcattaccacttgtttgaccaccgctatcgggctcgtcgccgccttcgctcaggacttccataagcacttcggtttcttgagttacaaannnnnnnnnncactggcatggaagtaccgattaaacgctaacccgtaccgtacttgttaaacaatttaatgaatgccaaataagcactgcccactattttgtgagcagtgcttatttgatacctcaagtctaacacgaacaattatcgcaatgagtcggcgttgtcatgaccgacaactccaatctatttgaatgttactttcattactgattgaccatgctgtacttctgttgaccaatcttcagtgtgtgctgtaacgcgaccaggttgcgtaaagaaagtaacaaccacatcgtcataaccactctgtttgatcagatcacgatcaaaggtcatcagtaaatcaccagcgtgtacgacttgcccatcttgacaataagtcgtaaagccagcaccacggaggttaaccgtcccgattcccacgtgaataattgtttcaagaccgtcagctgacacgattcctaacacatgtttagttgagaacgtaaaccgaatcgtcccatcgaatggcgcatagaggcgaccatcacttggcctgatagcgaaaccaactcccggtaagccttgtggctgtgcggcacttttgacatccgctaatgcgagcggttgaccgcttactggtgctaagatttcagtggtcagaatgtcagatgcaggcgttaccgcaacatccactgcttcccctgttgccaatttggcctgtaactcttcaacaatttcggcatgtttcttttcggtaatggttactttgaatgtaaagactaacaatgacaagattgcacatgctaacggcaagtaaaacgctgtgagttcaaacgtatgaatattacttgcagtcatatcggcggccgttgcactaccagtcataccagcaactaaagcaatggcaccgacgataccgttggaaaaggcaccagtcattttgtcgatcatcggccgaacggcaagcaccaccgcttcattacgattgccattcttcaattgaccgtattcaatggcatcggtcattgataggaccgtgactaattgggcaaagttaatattgaaaaggactaatccgatgatcaataaggtcaaattcgtctgcgcaacaataaagataatataggctaaaatcattgagcattgaccgagtgcaaagagcactttccgtggaataaaccggttcaagattggatatagtggtgacgtcacaaaaccgatcacagttgcgaccgccccagcaatccaaaattcaccaggtttaccaatcacgaatttaaaaagatagaatagaaccccgttggttatcacgtttgctaatgaatagagtaagtaacccagactgacccacataatttggtcattcttgataatgcccataaagacacctttgatcgtcgtcttttgtttggctgcttcccgaatcgcattgtgcttctcactggttccaaaggcgacaaatagtgcggaaatgactgccacaataccgacaataacggcaaacgctagccagccttgtggaccttgggtatgcttaccagttgcgataaaggtaaagtacgtggtaattggtacaacgactattgccaggccgttccaaccggtcgtcccagcaaaattgccaagagccgtgagaattccccgggcatgactatcttcactaatcgctggaaccatgccccaatacgagacatctgttaacgaatagaagacatccaagataataaataaaatcgcaaaaacaattgtaaataaaatccagtttacctttgctaatccaaagattcctgagaaaataacgactaataagaccgaactgataatactcccaatgacttgccaaggcttaaacttaccccaacgtgtttccgtattatcaacaatattgcctaagattggatcgacaacgacttccgctaaacgaatcaccaccaccagtcctgtgattaaaccaatcaaccgattggcgatagctggtgcaacgccgctaaacatctcactagtgacaaagacaataaaataggtactcaacgcaccatagaatgccgagtgtcctaagttacctaatccaaaggcaacgccttcattaatttgatgccatgataactttttcttggttactggttgttgttcaaaattttgtgccattaatttcactccacttaattatttattcatcatatagacttgaacaccatagctggccaagtcttgcttgccacttaccacttgattctcaaaaatttgccgtaacggcacttcaagtgtcaccgtcgttggtcgatgactaaaattgatcacgaagtaatagcgcgtcgtcgcattctctctaacttgaatacttaccttggcattcgctttgatcactggcaatgccggtttaagtgccaagcttgtggcaagccgtttatagaaagcatccaagaagtcagtattggtccgcgcagccaaataatacgccgctccctggcccaattgattgaccgttacagccggtgttccagcataaaaatctttttgatacgtgccgaggacttgtgccgttgtcgtctcaactacatcacaataatcattcacttgatacgcttggtgataagcagtcagtgcattatgttgttgcggatataatgtgtcagtttcctgaactttaatcccataagttgcttctaagtcagctaaaccatcaccttgataggctaagaagtcatgataaacgacgcccgtaatataggtgccaatcagatggccgccctgttgcacatatgctttaagcttagtcgcaaaccgggcgctcatcatgaagtgcatcggatcaatcaccaaatcataagccgtcaaatcatcagtaatcgcaataatttcaactggaatgtcatgttcccagaaatactggtaatgttcttgaatcgtgcgccaatactttttagtttcgttagcgtagttgcgggcatcatccaagccccacatgttgtcataatcaaagacaatagcgactttagctgcagttctggtcgttccatgcgcgacctgtaagctttgtaagtcctgaccaactttttgaacgtccttaaatgcccgcgtatttgagccacgatggttggcaatgacggcgccatgaaacatttcagaagctcctaatgattgatgtagttggaaatacaaaactgagtcggcgccatgggcaacctgttgcaagctccccatttcgtgcatgcctggtcgtttggcacgattatatgggtgccaattaacctgtgacggtgtactttccataatcaagtagttatcatgcttgaggatccgcatcacgtcattcatcaaagcagttttcatggccagtgggccgtactttcgtaaccattactccaattaggatatgaatcccaactcacaatatcgacatgcttcgcaaacttctgataatctaaatcataaaagccgtgtgattctgatggtttgccacccataaaattggctgtcacagggatattaggtgtcagcgctcgtaacggtttgatctcattatcaaaaaagtcaatcgtccggtctgttacaaaacgatgccaatccaggttaagtcccattacattcgtatcacccagcggcgacggtgcctgaacctgatcccaacttgtataatcgtggctccaaaaagcaccacagtaagcatggttcaaattggctaacgtttgatactttttttgaactcaatgacgaaaggcttgctggcacaaatcacagtaacaagcaccgccatattcattagagatatgccatagcagcaagcttagtcgttgaccgtaacgttccgccaacttctggttaatcatttgaaccttttctcggtaaactggcgatgtgtaacagtgattatgtcgctcgccgaattgatttcgctgtccgtgttcattgacacgtaacactactggatatttctcagctaaccagcgtggacgagccccgcttggcgtcgacaaaatgatcttagtcccttgggcttcggcacgatcgaaaatttgatctaaccagctaaaatcatactgcccctcagcaggctctaacttgtctcaagcaaagattcccaatgtcaccgtatttaacttagcagccttaaacgctttaaaatcctgcttaatcacctcgggttggtaaagccactggtctggattataatcaccaccatgcaaaaattctgttgtctttaatggattgaacattcaaacgcaccctcacttctatcaacttaattacgctttaacagctcttatgatagcactttcatttacgaatgtaatccgttttactaaaataattactaaatacaagtaaacattatttacgttttgtttatattcattactgcttttattagcgctaatgaaagcgcattattataagtgaagctttttacgctctcagaatagtccatggtgttggtnnnnnnnnnnagaatagtccatggtgttggtatcaagtaaaattgcttggtcctttttacccattccaacagcaaattgatccatgatcccggagttaacaccaacatagttgttttcgcacttttgaccaatcttaacaagatccaattggctaataccgagattaaagccagtgttcaacatgattccagttaataattcaattgatgcagatgatgataatccagcaccatcaggcatgttgccatggacgtagaaatcaaagccatgatcgaatttaacgccggtctttgcgatttcgtccatcattcccttaggataatttgtccaaccagcggctttgtcatatgacaggtcgttgacatcaaacgtaacgaccccagcatctggaatattagctgagtacatccgcactgtcgtatctgtccggggtgcataaacaccatatgtcccgattgtaatcgcacatgggaaaacatggcccccgttataatcagtatgttcaccgatcaagttaattcgaccaggtgagaaaaagacccgttctggcttggtatcaaaggcttcggtaaactcctgttttaagtcgctagtattcatgaaaaatccctccgtaaatagttttactaaaattttattagnnnnnnnnnncactggcatggaagtaccgatgaaacgctaacacaaaaatttatgtctcttcaaaacaaaacgagtatcctgacaaagccgtctgggatactcgttttgttttgaagctattgatccaatcactctacatatagctcacttcaacttcataaatcacactgggaccaccgcagttctattaggttccaaagattgtctttgcccatccacaatcaatgtcccaccagctcggctagcagtgactgatagttggtgttgatcttttacgacagtcacggtaccgcctttaatgggtaacacggtgtgtaaatgatgaaattctgataactcaggcttgatctcaaaagtctggtatcctggagccgtgggccgtaatcctacaaaatgacgacccaataaatatatcggactggctccccaggcatggcacaagctcttaccatagggatcaccatacatggcatacatatccttgccatgctgtgacggatcgaattcttcccagaaggtcacggccccgcgatctaacataccgccccaatagtctaataaaacttggtaaacacggtgttgttcccccagcttacataaagcatcttgttcaaaaaatttaaaatacggcgtggtaatttgagtaatcgcattattcaacaaaacattctttaaaattaattgttgtttgttctcatcaacaacgtcaaacagaatggcaaaaatattagcatgacgagtaacgtgccgcttacccgattcataactatcaataaatgctccttgttcatcatcccaaaaatatttcattaagttcttaaacaactggtcatacttcgcttggtagcccgccacatctttgcctaagacctcaccacaagtcataattgtcttgtagtcttcaagcaataagatttgttcagccgccacggtaccctgtttatccatttctgaccaatcgacaaagatccagtcatttttccgaccataaataaacccatgctcatttgtctgttgaataaagtattgcaccatactctctaacttagggtaaataattttgagaaattcacggtcacccgtcatctggtaatgatttagaacaccaatcacccacaacatggaatagtcgacaattgtattcatatgttgcttaatatcatcttgcccacgcaacgctgataacgtccgtttatcaatatcttcgttgaagaaagaatattgattgataaaattagcttggtacgcgtcaccagcccaaatccaccgatcacgtttgatcccatcgataaagaacaagtcactgcaaaggtttaacgtttccgtcgctacattccaaatttgattgatcaacttattatcagaggtaaaactggagggattatttttaggaatatattcgtgcatagcagttaattcaatgtcacctaactgacaatgaggcacaaagacatatcgaaacgcacgtttacgaacctttgttgtagctgtaacgtccgactgcttgtaataacacatctcaacatcccgtgcttcagtttcggactccccgtaacatagcgtaactggcccattcgttttgactgtgacagttccattcacagcgcgaccaaaatcatataaaacgccaccatcaactgcttgttgtgctttggccactactttttctgtccgatattcaatcacattaggatcctggttacagtcagtgtagagaatatcgtgaccagcgggtaatgtggtgacaaaattgctagctagccaaccactatcagatttgataatctcaccaacaatataaattgtcggcaatccctgaacgttaccaacaaacacttgaatatcagtcgcacccgcatcacaattaatcgcatgatttaagcgatacttagtgccattaatatcaacatagcccgttcctttggcgagtactgtaaattgtgtggattcttttaaatcatagtgccgtttaaaattaacattacggttgcaatcatcaatataccaataggcaggccaacccatcccacgttcttcacgtttaaaattttgtaacatcccttggtggatttcaaaatcaccaggataccataaccaaacagcctcttttgacatgagcattatcctccttgattttaaataaataagcccggcaatgcccggcttacatttttaattcttagtaatattaatcagtttattcagaaaccgttttcatcgttgggtcttttaaaccggtcttcttaataatagcgacaatgatcactgcacaggcaccgaatagcaccgtacatccaaccataatccataataagagttgcggcgaatatcccattaatgttggcgttactagcgagaaagcagcggtcagcacccgaactaagccataagaaaagcccgtcatcgttgcccgtgcatccactggatagaaagtctgactccaaattttataaagggcctcaccacataatactgtgctaccagagtagaaaatataaacaacggtgaaaatcttccagtcattactaaagatccctgcagtcacaaaggaaagcaatgctacggcaatacctaaatacatcactcggtagcgatacctagtgtctgaaacctttaaatagatcaggttaactaacagacacacaatattggcaattaatgccacgattgtcgaataggcttgcgtacggccatcaacagtcactaagaaatagttaacaaatgacccccacgtattggccggcaaattccaaaatagataaaaaacagttagtagaatcattggtactaacaaaccacctgttcgcaatagctgacctaatcgatacttcttaaccgattgaccgttagatgcacagtccacatgttcatggtcaactaagtctgtttcaatctgtttaaaacgctttgaaaagacccgcacgcaccaattaataattgccactaatccaatccaaccaaataaggctgccgggcttcccataccactgttagcagttataaaaccaataaactgtgacaacaaaatgcccatcgtccaaaaaatctgagttgaagaaattgcccgaccataaactttactagacatccgttccgaaataaccgccaatgacgttggtaaatcagcaccagaggccaaaccagcaatcacaacaccaataatcaatatcgtcgtattttgtgcaattgcaataataaacgaaccaatcgcgacaaaaaagatatcagcattaaacaccgcgacccggccaaatttatccgacagccagccgcccacaaatgaaccaattgcaaccgcgaccgtcagcatagtacttagtagtccgaccatccagctattcagtgctaaatattttgtccagataggtagcgctactcccagactaacgagcaacgctgcatccatataggaagctagaccagcaacaattattaagagtacgtttgctttactcagctttactttttcgtcaaccatcgcagatactcctcctaaacgaggtacttattaatcaagtacaccggtgtacagctccaagcatgacaataactatttaaaatgggactcccatacggcgaataatcaggttgattaggatcaaatgcttcccaataagtatccgcacctagcgtaaccattttgccccaataatctttcattaattggacggcctcttgctttaagcctgcttcaaataatgcttccgtaatatggtgatacatatacggcgttgcaataccagtaattggaaacagtttcgtgacggtcgtttgcataagcaccgtggtttgctcaggatccaaaacatgtgctagtgtcatccacacttggcttgccacattaacttcacgctgatcccctgagacaaataaccccgattgcgaatcaaacaattgagttttagcgtactggtttaatttacgcagtatcgctgtataggtctctaagcttgtatcattaaccagttccgcaagcgtaataaattgttttagcgtataaataataatggcctgcccagccgtttctttgtcaaaatcatttgaccagtcgatgaaaaccggattttcttcagtcaatttcaatttaccttcagaagtaacttgttccaacgccaaatccatttgctttttagcaacacgatataaatcattcaaaactgttttatcagaactaaacgcctcataatcagccaaaattgaaataaagaatagactgtaatcaaacaagaaggtgtcatctggaactgccgttggtttagtaaaaacattggcaggaatccggccagccgttgtaggcatcgcaccgaacaaatacagacaccgcttgaccagatctgtatctttgaacgttgcataattggccaatgcttgtagccgaagatcaccaatccataatcgccgatcgcgctttggtccatcttcaaagacatcctgcatacaatcagctaatgttttcaagccaacctcataaatccgttgtaattgtacatcggctaattccggttgatgcactgtcgcagtgtctaccgcacttgtcgccgtgaccactggattgctaaaaacagctcgccattttggtgacgtatcaacaactgtgatctcagcataacgaaaactatagcgtcgtggtaacgtcagcgtggttggcagcacatctaagtgaacagtttcttcttgaatccaagatttgctcaaccaaccgtcgtaatcttcactcttgcgtgctaattctgcaggcatttccgcaaacttaatcttaaaacatagtggtgcatccattggtgaaccaacagcgttaatattaatactaaattgaccaacctgatgatcgccaaaatctatgataatttggtcatcacgtttcaactcataacttgataatcgttcaataggtgcaatttgtttaacacaccatccttcaaggtattgcgtatcacgctcgagcgccacaatcgatgccgccttagctttggtttctttcagtattggccgatagcttgccgacttgtctaataatgcttgattatgctgaaattgaacatcattattgatttgaaaagtaaacgccatctcttccactcgctttctaaatactttgtttaaaagttattaataccatgcttcttttccaatcgcatcatcgtcagccctgctacaaagctaataaagacaatggcagcgaacccaaacatcgtgttacgaattgctgatggcacaactaacgcaggtgtaattaaggcaaataggccacaacatacccgtgaaaagccattgataaatccttgaactgatgcccgaacttcaactggaaatgcttcctgtgtccaaactttatacatcgcttcaccagcaatattattcccaatgttgtaacagccaatcgtgatgacaattggccataacgaatgactactcatcgctagtccgagcattgccaaaaattgaacggtaatcccaactaagaagaacttattacgatacttacccccagcgactgatgcaaaagccatggttgccaacaacgagataaagtttaggactatcccagcaccagttgcgaaactttgactcgcatgtgcttgaaccagcgtaaacgtttgaaactgtccgaacgtattggccagtagattccagcaaacatagaagattaaaatactgaagaagaatgccataaagcgtcccttgttggcaccagcgaaaaccgtcttaatcgagaccttttctgttgtctgtgaagctgcttcgcgatcaatacgccgttgttcaccttcttcatgaaatgctcggaacttagttgaaaaagtccgccatgcccaagtaatcaaggcaaaaattgctaaaatcgaaaaaacaatccgagcaccggaagcaccggccattttagaaacaataaaagcacaaacataagacataaaaactccaatttgccagaagatttgcgtcgacgatactaaactagccgaggtcttatcatccggtgcatcatgcgaaactacggttaaactaattggtaaatcagcacccgaagctaacccggtaatgatgacgccaatcaaaagcatgatataattattcgagaaaacacagatcaaggcgccaatcgcataaatcaggtttaaccaattaaacgatttaactagaccaaaagattttgttatctgtcctgctaataaggatccaattgcaattgcaaaagttagtgcacctgaaataataccaacttgactgttagtaagacctagtccgttctgccacactgtaatagtcgcggataagccaacgataattcctgatcctagaatggaaccaattcctgcagctactgctaatggccgatattttttcaccattgaagttgacgtctcgccgttattcatatgaagaacctccctttatttatacgaatattgtaagcgattactgtaaggggtaccatatctcgactacatgaatgatcgtgcaaaatcacaggttccactaaacgataaatattaaagaaggttagtattaatgactagtaaatttctcaattacgaattatttgctctgacaccggttgagctaaagcaacgccaatcacatggtaacgttaactacatggacttagattatgtgaataatccgattccccagatgccccgctcagatttttttaagcacggtgatattgctgttaccaaaaataatcgcttttcctatgttccagctcacacgcatagctttattgagcttaattatatgtatgctggcacttgtactcagtatattaatggcgaaaaagtgaccctccatcagcacaacctaattttgatggataaagacattgttcagcaaattgaatcaacgggcagtaatgatattttgattaacatcttgctcaagaatgactcaacgatgaaccaacttttcgactatattgccgtttcaaccaatgaaatcactcaatttttatataatgcatcccacatcaatacgttgcacaacaactttattctgtttgacttaacacaccaagaagttgccatcaatctagttgaaagtttaattatcaagggccttacaaagagccgccaacgtaataaatcaatgggcctgctgctatctacattaattcttgaattatcgcaatcgattgagcaagaatacattaacttttctgacaatacggacgacaatcttttgccaatcattcagtacatcaatcagaatttcgccagcgtgacattacgtgatgtcagcgccaagttctcttataatacaaattatctgggtaacaaattaaaagaagcgacgggcaagacctttaaagaacttgttgaccgccgccgaatttctgctgcccaaaatctgatgatcaagactaactgtacactcgctgacatttgcgacatcatcggatatcaaaacacctcatcactctttcgtctgtttaaaaaatacctaaagaccaccccatccgaatataaacgaaaagttagtggcccactcaagcagtaaaattgaccgctgcgacaaacgtcatatatctcactaaagtaaaacaacaagtgcactcagattagaaatttccgagtacacttgttgttttactttaagaccattcttagtatcacgactaacaataattgatctatttggttagtacttccaggaacacctgtgccatcatctcagcatcatcttgaattgacgcttgcatgtaagcgtcctgctgtgcctgggtatagttgatgtcaaaaccatgctgccaagccaaaacctcagtaaacagccgcgtcgtgcggccattaccttcccgaaacggatgaaacatgttgattttggtgacaacttgtcccaacgcctgtgcaagctgttcccggtcattcggtaacatcgcaaaattatcgagttggcgttaaatatccatttcagcattaccaaataaagccaccgggtggaaaaacgtcaccacgccattcgcagtcttgttgaaatcaacttcgcgatagtgacccgcccagtcgtaaacttcgccgagcaaaaatgcattaatcagtttcaattctccaatttgacgtcccgtcaattatcgagagtccggtagaagataatggttgcgagctaattgctgttgtcgttgcgtactcactttgtactcgattttctgcaaagtagtcgcttcagtaatgcccaagcgatttttcaaagttccatttggttgtaggtaatccgcccatacttttttcattcagctttcctattggtcgaagtacatatctttgctagcatctcttgggcactaatcgggccttcgtcatagaaacgacgagcatcttggatatcttccttagtcggttcaaaaccttcatacatgttactgataattgcattcatggtcgcccggtattcctcttgattccgaaactgcacacccatgatggtgaacttctgatcatcgtgttctaaatacataatcgtattctcctcctcgaggtttgtcagtgcggtatacaccgcatcgtccgtagccaaaatctgaatcaaacgtaccgcggtgccacttggttggtagtccgcttgttcccagtgctgcaccgttctaaccgaggtgttgagtaactttgccagctttgcctgactaatttggtaatgttgccgaatctccttaaggattgtggcggttgttttcattttcatcacctcactcacaattatacccttgaagggtataattgtcgttgctgtggcctcacaccttagcaaaacagaccaactaatcagaaagcagcagtatgaccaatcaacccattcacgcgcgctattcaataccaaacagtaccccattaaagtcatgcaccactttttagcaatcgggtgacacattaattaattacgatatttctgctaaatttcacgaacactcgatgatttcatttggtgctttcacgttctaccaacgtcgttcccagttcaatgcgctgggctgcttgacgatcatcttggaaccggctcaccaacaaatcgatggccgtctttcccatcagttcagtctcaacattgaccgagctaatctctggatacacatattcggccagcgtcgtgttattgaagctaaacaacttgacccgctgtggcacagcaatatcagcttgctgtaacgctttgagtgcaccggctgccatcggatcattagcgataaagaaggcgtgtggtaagcgatcacctaacattgcaatggcccgtttcatcatcagataaccagattgactagtgtaatcaccagctaatacatactcagcatgataggcatgatgccgctgcaacgcctgttcaaagctttgctgacgttgattgggaatctccacctgctgatcagtggaccactctttgccataaatcatgccgatatcctggataccacgccgccaaaaataatcaacgacacggttagtagcaaacgtaaaatcagtcaccacactgctaaatccctgagcaaagtgatcgtcatcaacaaaaacaagctggtttgacaaacgactcaactgttgtacttggacaggactaaatttccccaccgccacgattgcatcaatatcatcgccaacctgacctaaattattctgaaagatactagtcgtcgtaaaaccacacacttgagcttgatgctcaattcctttacgaattgctaaataatataagtcatcatgttcttgagtcttagaataccactgaatcacagcgatatttttccgcattagcgcctttatatgctgacgtttacgcttactgtaccgcagctcgccagcaatcgtaaacacgcgcttgcgtgtctgctcgctcactgatagtgtcttgtcataatttaagacccgcgataccgtcgccaatgagacatctgctcgttgcgcaatatcttttaacgttacggccatcgtcattcctcttttctcttaattagcactgaataacaaacgtggggcaactgggcgtaacactattcaccaaccatgactcatcggtaaatcgcgtctgcaacaccccgttgccccacgtcttcatttgattaacaacttaatcgtgcattgctgcgacaaaacgatcaaaggctgcctcaccagcgtcatcccacttaaagaccccagcatcggccagaacccgggcaaagacgttgccgaccgccgtatcaatgacagtcgtcacattgtcagcggtgatggtattagtggccttcaattgatcagcccatgcttgatgcatcgcgaccatttgattaggctgatccaacaagtatttgccgacttcagctaattcggtcttcaaccgggctggtaaaatggcccggcccatcacttcaatcaagccaatattttccttcttgatatgttgaacatcctgatgtggatggaagataccatctggaaattcagcagacgtctgattatcacgtaaaacgatatctaatacgtagtcatcgccaactttgcgtgcaatcggtgtcgttgtatgatgacgtgtgccatccgtataagcacgaacatccacactctcgtccgaataattcttccacgtctcatgaatcttcacagcggcatccgttaatgcaaccaggtcctgactcgtcagccgaatcgtcgacatcggccatttaacaatcccagccttaacacccgcgatacctaagtcaatcgtgcgtgcaattggcgctttcatcattggaaattcgtgccgaccaccttggtaatgctcgtgtgacagcatggaaccaccaacaattggcaagtccgcattactgcccacaaagtaatgtggaaattgctgaacaatttcaagtaagttggtaaaagtttgccggttaatgaccattggccggtgctcttgatccaagaaaatcgagtgttcattaaagtaagcatatggagaatattggaaaccccaagtattgccgccaagtgttaaccgaataattcggtgattgctccgtgctgggtaaccgagtcggcctagatagccttcattttgcatacatagttggcaaagtggataaccatcttgcggttggttacgcgctgccgcaatcgctttaggatccttttcaggctttgataagttgatggtgatctcaaagtcaccaaacggcgtttttgctggaaagaccacgtttttcgcaatggcccgcgtcttgatataatcattagctttgcttaagttaaagaaatagtcggttgccgtttgcggactaacctgatacttatcccaaaaacgttggtttaatacggatggtaacggggtcacaagatccatcaattgatccgctaagatatcttcatccgattgggtcgcttcgatcttgccattttgaatcgccgttttaaccaaggcatcggttaaacttgttaattggtcatcgcttgccgcaatcggatcaccctcgccgaccaaaccaagaacccggttatgcacatagattcgatctaattcagtatattgcgaaggcgacgcgatcaccgccgtgacaaattgatccaaactcgtcattatgcttggcctccccgatcatcatagccggccggatgactttctttccaagtccaagccgtcttgataatttctttcacatcatcatactgaggtgtccaacctaaaacggtacgtgccttgtcgctagcggcaaccaatgtgcttgggtcaccagcgcggcgtggtgccatgactgctagaattggcttaccagtgacttcacgagcagcgtccaacatttgtttgttggagaagcccgttgaagaacccaagttaaacgcatcgctatcgtgcccctgctttaggtattccaaggctaagatatgtgcatcagctaaatcgacaacgtgaacatagtcccgaacattggtcccgtctggagttggatagtcgtcaccgaagatttgtaattgatcccgttcaccagcagctacttgtaaaataattgggacgagatgcgtttctggtgcgtgatcttcgccgatgctgccgtcaggcttagcccccgccacgttaaagtaacgtaaggccacgaacttaatcccgtaagccacatctgaccagtgcatgatcttttccatcgctaatttactttcgccgtatgggttagttggcacttgtgggtccgattccttgattggcacctgcttaggttcaccataagttgctgcggtcgatgagaagacgattttcttcacatcgtgcttagccatcacttcgagtaacttgaccatccctgccgtgttgttatcaaagtacttgagcggatccttcatcgattcaggaacaactgagaaagctgcaaaatgaatgacaccttcaacgttttcttggtcaaacacggtattcatgaacgccgtatcccggacatcaccttcataaaaacgcgcgtgttcattgactgctgcccggtgccccgtgactaggttatcaacaaccgccacgtcatacccctttgcaaccaaccgatcaactgcgtgtgaaccgatgtagccggcaccacctaaaactaaaactgccattctaattcctcctcaatatttctcaatgcttactgctaatttgtattttaaatcaattgttttattaaagttccttagggccgtctgcgatttcagcaatgtagaaatcggcgtcgtaaccaatcgtgtcgcgataaactttaccgacgttttccttaaaggcatcaacttggtccttatcaacgatggcaataccacagccaccaaagccagcaccagtcatccgcgcaccaagcacgcctggttgtttccaagctgtttcggccaacgtatccaattctttcccagtcacttcatagtcaaagtgtagcgaaacgtgggaagccgtcactaattcgccaaaggtcgtcaaatcatcgtctgccaaggccttagttgcgcgaatggcccgttgattttcgaaaacggcatgccgggcgcgcttgattaaagtttcatcattgattaagtaggccgcttcgtcaaactggtcattagttaaatcgccaagtgatttgatgtctaacttagcttgtaatcggcgtaatgcttcttcacattcggagcggcgttcattatattttgaatccgccaattcgcgccgtttgttcgtattcatgataacgattacgttgttgcccaactttacgggtgcataagaatagtccatggtgttggtnnnnnnnnnntaactttgaaaggagcttcctcatgcaagctaatcttcaatggttagatgacccagaagtcttccgggtcaaccaattacctgcacatagtgatcaccattattatcacgacacagcagaattcaaaacgggtagtcgcttcatcaagagtctcaatggcgcttggcgttttaacttcgccaagacaccggctgaacgcccagttgatttttatcaacccgatttcgatgcaaccgactttgatacgattcaggttcccggtcatattgaactagccggctatggtcaaattcaatacattaacacgctatacccatgggaaggtaaaatttatcgtcgcccaccgtataccctcaatcaagatcaattaacaccaggcctattcagtgacgctgcggacaacaccgtcggctcgtacctcaaaaccttcgatctcgacgatgcttttaaagggcaacgtattatcattcagttccaaggggtagaagaagccctgtacgtctggttaaatggccattttattggctacgctgaagatagtttcaccccttcagaatttgatttgacgccgtatattcaggaccaaggtaacgttttagcggttcgggtctacaaacgcagtactgctgcctttattgaagaccaagatatgttccgtttctctggtattttccgtgacgtcaatatactggcggagcctgctagccatattactgatttggacatccgaccagttccaaatgccaatctcaaaagtggtgagctcaacatcactactaaagtaaccggcgaaccagccactttagcgctgaccgttaaagaccatgacgggcgagtactgacgagtcaaacgcaaaccggtagtggcagtgtaacctttgataccatgttattcgaccaactgcacttgtggtcaccacaaacgccgtatctctatcaattgacaattgaagtttacgatgctgatcaccaactcttggaagtcgtcccatatcagtttgggttccggacggtcgagctgcgcgatgacaaagtcatttacgtcaacaataaacggttggtgatcaacggggttaaccggcacgaatggaacgcccacaccggtcgcgttatcagtatggctgatatgcgcgctgatatccaaaccatgttagctaacaatatcaatgccgatcggacctgccattatcctgatcaattaccttggtatcaattatgtgacgaggccggtatctacctaatggccgaaaacaacctcgaatcgcacgggtcatggcaaaagatgggggctatcgaaccttcttacaatgttcctggcgataatccacactggttagcagctgtgatcgaccgggcccgttcaaactacgaatggtttaaaaaccacccatcgatcattttttggtcacttggcaatgaatcgtatgctggcgaagatatcgcggcgatgcaggctttttataaagaacacgatgattcacgactcgtccactacgaaggcgttgtctacacaccagaattaaaagatcgcatttctgatgttgaaagtcggatgtacgaaaagccccaaaatattgtagcttacttggaagataacccaaccaaacctttcctagattgtgaatatatgcatgacatggggaattctctgggcggtatgcaatcatataatgatttgatcgacaagtatccaatgtatcaaggtggctttatttgggactttattgatcaagccctcttcgttcatgacccaatcaccgaccaagacgtgctccggtatggcggtgatttcgacgaacgccactccgattatgaattctccggtgacggcttaatgtttgccgaccggacaccaaaaccagcaatgcaagaggtgaaatattattatggcttacacaaataatcaactacacgttatttacggcgacgggagtttaggactacagggggctaatttccactacctctttagctacgaacgtggcggacttgaatcactcgtcgtcaacgataaagagtggctctatcgtacacccacgcccatcttttggcgggcgacaaccgataatgatcacggtagcggcttttcagtcaaatccgcacagtggtacgcggccgataagttctcaacttgtcaagatatcgaattgacggttgacgaccaaccagtcacaccgttaccaatcgcgccactcaataacaaatacacagatcacgaaatcgccacgaaagtctctctggcttaccacttcgttaccacgaccgttcctagtaccatcgtcacagtgacttatacggtgacagcagacggtcagatcaatatcgccacccattatagcggtcagtctgatttgccagagctacccgcatttggtctgcggtttatcatgccaactaccgcgaccggcttcgactataccggtttgtccggtgagacttatcctgatcggctggccggcgcaacgcacgggcaattccacgttgacagtctgccagtcacaccatacttggtcccacaagaatgcggcatgcacatgcaaactgaacaagtgacagtaacgcgatcaacaacacaaaataacgctgaccatgacaacacaccgttcagtttgacatttagccaagccgatgcaccattcgccttcagctgccttccctataccgccgctgaactagaaaacgcaacgcacatggaagaattaccattagcacggcgaacggtcttatcaatctacggtgccgttcgtggggtcggtggtattgatagttggggaacggacgtagaagccccatatcatatccccgctgatcaagacattgacttcagctttaacattcatttnnnnnnnnnncttcagctttaacattcatttttaaaaattaatttgatttcaaaagaacgctccggcaagttatttgccagagcgttcttttagattaacgatgatcaagttttaatatgtttaatggctgagcttagtccttagccttgaagtaatgtacccgcgccgtaaagtcactagtttgaacgggagtcgtgtagagtcctagttgcatcaattcatcgccaccgtacattttgtttgtgtcggtctcaacgtaggtctgctgagggtctaatcccgctaacttcgtaatatgcggttctggttgaactgcacctaaaataacgaaggtgaacagcaaagcttctttctgatccggactaacaaacatccacgccaccgtattagattcaaacgggctctctaatcgataaaaggtcccgtattgaactaactcacggtgctgcttatagaaggcaacctgtcttttaacggcctgcttgtccgcatcacttagttgggccgcgtccagttcatagcccaaggtaccactcattgccacagcaccacgcatcttcatcgacgtcgaccgtcctaacaattcatccgggctcgtcccaacatgggcggtaattgcagaaattggataaacgagtgaagtcccatattgaattttgagccgttcaatcgggtcattattatcagatggccaactctgtggcatataatacattaaaccagcatcgaagcggccaccaccgccagagcagccttcaaataaaatctgtggatagtgtttcgttaaacgctccatcaagtcatatacacctaagataaagcggtggctagtctcaccttcatgagctgaatcgctatgtggcgaatagacttccgttaaattgcggttcatatcccacttgatataatcaatgggcaccttatcaagaactgcggtcatttgttcaaaaatattgtcgacaacatccggttggctgaaatcaagcacgtattcgttccgcgataacgttcggccacgatctggtacgcctaacacccagtcaggatgggcccgataaagttcggaatcggctgaaatattttctggctcgaaccaaagtccgaaccgcatccctttatcatgggtccgtttactaatatccgctaagccctctggtaacttgttccgattaacaaaccagtcacctagcgaactattatcatcatttcgatgaccgaaccaaccgtcatccagcacaaacatttcgatacccaatggtgctgcagcatccaagattgattgaatcttgtccgcatcaaagtcaaagtaagtagcttcccaattgttgatcaagatcggccggagatcgtgcttgtaacgactgcgtgccacgcgatcacgcaataaatcatggtaggtttgcgacataccattaagccccgtcgtcgagtataccattgcaacctcaggcgtttggaaactagcaccggccgccaatcgccagtcgaaattatattcattgattcccatagtcaagcgcgtctgaccaattgggtcccgttctaaactaatctggtggttacctgaataaattagcaatgcaccaaggacattgccttgaaattcattagtattcggatcagctagcgccacaaaaggattcatatgatgagaactagcaccccggcgactttcaaactgagttacacctcgatggagccgttcacgactaagctggcgctcacgcgcatagcttccaggtaacgaaatggcatctaatggttgggttggcaggtccatctgcatcgaagccactttttctaagtcgacagcttgctcactgtgattaatcaaccgggcgctacgcgtgataactggccgatcacgataaatcgtgtaggctaattcgagtgtcacgcctaatgtggcatctcgcaacgtcacaatcaaagtttgggcttcatcctcatcttcgacataagtttgtggcaagcccttaagttccggcttaccggcttccatccggcagtcttgataacgaaaatcaactgttcgagcaccattggccgcgcgaataatcgcggcgggttgccgataatcaccggtattattgccaccgtattcctgtggcaaatcatccttggaatagcttcgatcagtcgtattcggtaaatttcctgagaacccccgatcaatccggggatactgacgctcgccatgataaccccgaacccgtgggccaaagtacaagtgggccaacacgttgcctgtctccacacctagaatatacgatatttgatcgttatgcaggtgaaagacaagttgttcttcatcaatgtcaattaaagtttgctgcaacgttactgccatagtaaaatcttcccttcgctattagctttttctatttcagttcaaaaaaagagctattaatggctcgcgtcattaatagctctcctcgtaaagaaactatgcttgatccggtaagccgacattcgataattgtaagacatcttcatcatcttgtacggtggttcctgaatctttaagatacgtaaattcgggcatatctttatagtttgtaataacgaccataacggtatcatccaagccagccttttcaattgctggttgccagaattcaattaattcttgcccttgtgtgacatggtcgcccttctcaacgtactgaacaaatccagtcccacgcatcttaacggtaccaatcccaatatgaattagcgttaaaataccggtatcagaacgtaatccgattgcatggcgagtcgggaaggttgcaacaacttcaccatcaaatggtgcgacaacgcgaccatccgttggtttaatggcgaaacctttacccatactaccgtttgcgaaggattcgtcagcaacatctttcaaactgagcagttccccggcaacaggatcttgataaaccgtcgtcttggcatcggcttctgcttcaacttcagcaggagtttcatcggtttccaagtgagttgaccatgttttttcaagttcatcaacgatttgtgcatgcatcttttcatccaacttaaccttcttgaagaagatgaatgtcccaatcaaaatcatagcagcaggtacaccgaacatcattaacttgaagatggcagcgccatggctagtcacatcaccagcagtggcaccagctgtcatcccagcccaaacagcagttaaaccaacgacaccgttagaaatcgcaccgcctaatttatcaagtaaaggccgaacggataaggttaaagattcgtcacgatgaccaaacttcaactgcccatattcaacagaatcactcaaaaccatcaaaacaactaagaaaattaatggttgtggaatgtagaataatacggccgctgttaagatcattggtaatgactgaccagcaaaggcaaacatgatcagtgaaatcatcataataacaactgctaagaagaacactttacgacgactaaacttctttgctaatggtgggaaggccaatacggcaaaaatcccaataatcgcatttagtgaacctaatagtgtaaacttcgaggcgtcacccaaaatataggtgaagtagtaaagttctagtgagttcgtaatggcaatccctgccgtgtagatcccatacatcaatgataaccacatcaattgatcgttacgggctaacactttgaagacttccttgaagctagtcttttcagtgttcttacgcaattcagaatcattctctttggttccaagtgcaacaactaaggcagaaatcaaagcgattgcggcaataatgatcccaaatgccatccaaccacggttgtcaccttgaccactgttagacttaacagaaaacattaagacgattggcataacgataaccccaacgatgttggcaccaatgttagagccaacccgggcgtatgtcgccgtcttttcacgttctgctgagtcaaatgagattgctggaatcattgaccaaaaaccaacgtctttaaacgaatagaaaatatccattgtaatgtataaaattgcaaaaataattaaatatagaatggggtttgaggtatttaatccgcctaaactcgtgaataaaagtgctaaaacgacggaacctataatcccaccaatgacaatccatggtttaaagtggccccaccgagaattagtattatcaatggcattcccgatcaaaggatcaattgctagttccacgaaccgcaaacctgcaataatcatggtgatccaagcaatcatttgtgttccttgagccccactactcttatcgaacaagtgggaggtcacaaacataataaaataagttgataaagtggcatagaaggcatcgtgcccaaacgccccaaacgaataagcaagtcgcgatgttattttacgacctttactctgctttgtctctgcatccataatctcgcctcacatcttccttgaataatttacaaatttaaatgtaaccgttttcagaagtaatgtcaatgatttttagtaaaatttgttcaaaagttttatctataccgcttttgattaggacctgctaatgcgcctatcgacactgattgcccgctttccaagggcttaagcagtatagtactcattatcttaccaatgatcatcgttttactaatcacggtattaatcagatgctcgggactttgttaactaaattaaacattgtttactcatacgtttacaaaaaaggcgccaggcagaactcgcctgacacctcaactagtattaatttaaccgttcatattggtaccgaatcgtatgcgtcactggtgctcctggacgtaacacaatatcaccaaaatcaggatgattgattgcatcaggaagtgtctgggcttccgtcgctaacgcattatattgatgcgcgtcttccttatcagcatcaaacggattagccgtgaagataataagactatttcgatctgaataaatttttacttggcgcttatcatcagtatccccaacgatagcaattggttctgccgcacttggggcgacttcatacgcatcgtcaaattcaatgccaccattctcagtcttcagctgggctaatgccttttcaactggttgtgcctggttaaagtcatacgctgtgcctttaactgctaatttcttaccagttgggactttttcatcatcaaattccaagtgagctgcactcgtaatctgtaatttttgttgggccaaactggtccgatcatcagttgtgttccaataaacgtgattagttggattaaagagggttgctgcatcagtatcaccggtaaatgcaatggatacttgatcctgattatctaatgtaaacttgatagcgacatccatatttcccgggtaattatcatcactggcgttgatatgcttcttcaaagtcacactgacactatcattggtttggctaaaagcaccttcaaagttcagcgtgttaaaaccatgattcccgccgtgtagcgaatgggtttgttcgttcatatcaacttgataggattgatcatcgattttgaacttagcgccgccaatccggccagcaacccgaccaattgattgacataggcagtatcccactcgttgatagtcagtcatgttatcaaggccccaaatcaagggatgctcaacgccgtcttcattgacgacgaattcttgccacgtcccaccataactaaggaccgagatacgagtttgatggtcattgaccagcgtataacgcattacatcttgaccatctagttggtcaaacaccgtttttttagtttccaaaatcatgcacctccgtgttatttaaaccgctttcatttagaagtataccagaatttcttgaagttgagtaaaacttttagttaaaatactaaaagaacgatctggtttctatcccagatcgcccttcactacttggaacttgctcgctcaaccagattagtacccagctcaacccgttgtgtcgttgttcgccctgctagtcgactgatgaccaaattaactgcggtcgcccccattaactcagtatctacgttaactgcgcttaattcgggataaacgaatgtcgccagcgaagtattgttaaagctaaatagcttcactcgttctggcacctgtatgccactagcttgcaacgctttaagcgctcctgccgccatcggatcatttgccacaaagaaggctcctggtagctgatctcccaacttacgaatggctttttgcatcattttaaacccagattcactagtataatcgcccttaaaaacgaacttaggatcaaacgcatgccgtcgttccatcgcggcccgaaaacctagcatgcgtcgatcaactaccgctaactgatggtcggttgtcatttcttgaccgtgaataaagccaatatgatgaaagttgcgttgccaaaaataatcgacaactttttctgtggccaaccgaaaatcagtaatgacactatcaaaaccagcatcaaactgatcatcatctacgaatactaagttgtcagttactgatgccaagtccttgacttgtggctcgctgaactttccaactgcaatcactgcatctacgtctggtcccaattcttgtaaattattttggaagatccgagtcacttcaaactgattatcctgtccacgacgttcaatccccatccggactgacatataatacaaatcatcttgttccttagattccgaataccattgaacaatagcaagtcgcttacgcgccgtcgtgacagtatgccgtttattttttgaatactgtaatgcttctgctgcatctagaattcgttggcgcgttgtatcactaacagacaatgactgatctttgtttaacacgcgcgataccgttgccaatgatacgccaactttatttgcaatatcttttagcgtcgccgccatgaattggcccccttaaattcaaactaattcttactaccatctaaagtcgctatcgcatgatttatttgcaaattattttaattttcaagtattgcgccgaacttcaacgcataatcgtgataactatcatgtaaaactttatcattaattgtgaaaattggcgaatttaaacactaatttatttagtaaagaccccctgtgcgtgcaaatctgcaaaattatgttattattaacttaactattaggtacagaaagggccatatcctcggatatggccctttcttttgcggctctataacattgactatagcgaattgtgcaaacgctatgatcgaccagcattccaatcaattgccggttgttcggtaagaatctgttcaatcgttgctaattctgattcactaaatttcaacttttccaatgcagcaacgttattaaccacctgctctggccggctagcaccaatcaagacacttgctaaggctggctgacgtaggttccaagccaaagccatttgagctaagctttgctcccgttgttgcgcgacttcatttaagcgctttaccgtagctagtgtctgttctacctggactggactcaaaaatggaattgtttgcttattggcccgtgaatctgtcgtgattccgtgcagatacttgtccgtcaataacccctgtgatagtgagctaaagccaaccgccgccttatgagttgcttgtagaacggggaacaagtcctgttccacctgtcgattaaacatattatagcgtggttggtgaataatgtatggggttcctaatgattcaaatatcttggtcatagcagccgtctgcttgccattataatttgaaatgcctacatacaatgtcttaccctgccgtactagctgatcaagcgcagcggccgtctcctccattggtgtttcaggatcaggacggtgactataaaaaatatcaaagtagtctaaaccagttcgctgcagactctgatcagcactggcaataatactttttcgtgacccccaattgccgtatggtcccggccacatcacatagcccgctttactagcaatgaccatttcgtcacggtatggccgcatatcggtagccataatacgaccaaaattagtttctgcactgccggactccgggccatagttattggctaagtcgtagtaggtaattcccaaatcaaaagcttgatgaatgattgccttttgattagcgatcggatcaacgcttccaaaattattccaaagacctagcccgattgctgacagcttcaaaccactattgcctactcgattataaatcatatggtcatagcgcttctggcttgcttgatacatattaaacaccctctcgttattcgttcctagctaaagttaccgctttcattagtaaaaagcaacgcctgttttaccatgctacctccgctaagattattgagacatcgaacgctctcacttgataatttatatatatcaattacaatatattattagaatataaacgtaaaggagtacttattatggaccctaaatttattgaagttatcaaagacacgacccccgcaaccatcgttacggtcaacgccgcaccagcacacgtcgtcaacacctggagtcattatatgcgacttatcgatgatcataccctattgatcccatcggctggcatgcactcaattgaggccgattttgctaccgacaaccacattacaattgctgtcggtagttacaaggttcccggcacaactggtactggctgtggtttccacattcatggtaccggcaagtttgaaactagtggcgcttatttcgatcaaatgcatactaagtttgattggattcgcgcgaccctggttgtcacaatcgacgatgtggaacaaaagatttaacaactaaaatctagactaaaagaacgtacacgagttgtgtacgttcttttagtctagacagtagttaattcgtcactgtcttcttagatgctaattcaagcccctctaaaaagtgcccaaagcactgcttcaagaagtgttcactaccgtcatcattcagatgatcgttctcatcaaacttattgccggcttgaggtaacatgaactcgttaccaggcataactttggcatccacaccgggtgagtccaaaatctgtcgtaagttcatctgagcacgtaccgtaccttgaatacctaacgaagtcccaacaatcatcactggtttgtctttgaatggatgttctgcacaggacagccattcaatggcactcttcaaggcagctggaatcgaatgatcatattctggcacgccaaagacgacaccatcagcggcttcaatcttagcggctaacgcttttacacttgccggttcccgatccatatcatcttcattgaatagcggtaaatctttaatttcacaaatttcaaaattaacttgcgtttcaaataattctttcatggcatacaacaacttacggttatatgattttgaagcgttagtccccacaatggccacaatattggcttcgtcatcgcccgcggttgcctgccgctgagcgttttcgctagccgcggcgccggcaacgtaacccgacgaaatcccccaagtattcatcatacttggcattgaatcatgtccgttagcgccgccgatgatttcccccgcaccaaagtaattagctaccggtgcatttttagtcgttaccaattgcaagttatcagcatcaacactatagccacctaaagtcgtcgcaaagcgatcacgttgttcaatgatgtagaatgtttcaccttcaaattggtgcaagtacttcggatcacgaccgaaatcatgatcgtgaccatcttgaacatagccttgataatttttgaccgtttggactaattcatcaaccacaattccggcctgctcagcagcactttccaaagaacccttaacaaatactggccgtttacccttattctcaaagaagctcttaatttcttctggtgtgaaatcatgcaggatcagtaggtcgtaaactttcttccaagtccgttcatccattactaggtaagcaactttatccgcttgtttaaggatggcattccgaaaagtcgtataaacatttgattcgttaacgattcgatcacccttagagttaacgtaaattgcacccatatcagttgcttgtttcgacgcgtacgtggtcaatttagcaacgcctggttccacttcaacaccatgtggatacagcttgtaccaacctaaatcgtgcgtttgcaaatccaaatcaccattaaattgataggcatccccagtggaagtcattgggccataataatcaatgccttcgctttcagtaccacgcatcttttggttagcgccatgaccacctgcagcaagcacaactgaacgtgccttgatgttgactgtttggtccttttggacagcaatcacaccgcgtaactttttatcgttgtccaacataagcttctcgactcgagtatccaacataatttgaccacccgcagcagcaaacgccttcgaaactttttgaatgaattcatagctacttgctgaaggtagttcaatctgacggttaatcgaatgttctggcgtttgcgtctgtgctttttgataatgtaaatctgcaaacttactaataaaatcaatggctggaccaatgttatgcaccattaggtcggtcaaagctggatagttcgtctccaagctttcacgagcaacatcttgtgccaacatttctggcgtatcatgattattatcaaaaatttgtgcagcaacatcagacccggtaccaacaacgttagaaccattcagaatcgtcgcaccaccaagatagccgttcttttcaactaagataaccttctgacccattgtcaacgctcgacagccagcgactaagcccgcttctccgccaccaataatgagcacgtcggtccgcaagttttgcgtcttgggggcttttttcttaggaactggctgcacatcaacaccagcatcggttacagccttatctgccgacttaagtaacgcttgggtcatcaccgttgcaccactaattgtgtcaacattgaatgattgttccgtaatgatattttgtttcaatttatcaatgacttggttaaagatccccgacgtttcagaatgctttaatattttcaaatcctcaatcttattatcttgcacgtcaacttcatagttgataataccgttgtggcccattgcttggccggtaatttgttttttactcaatagtaaacactcctttgcgtcgcggcgttaagccactggtaactgttacctgttgttcatgatcaataaaaattgcttccgtatgtggcaactgttcgattagttgacaaccacggtttggcccttcaaagtaggccaccgttgataacacttcagctaattctgaccgttcagttataatcgacacctgatcaacttgattttcaaccggataaccagttcgcggatcaaggatatggtggtagcggtgattgccaattttaaaatatcgttcgaagatacctgacgtcactaccgttctagcaggcgtttcaacctgtagcgctggatagccacgtggcgcttcgggtgcttgaattccaacttgccaacgccgattatcggttagcggattggcccctaatagcttaacgttaccaccaagattaacaatagcgctggtaatgccagcctgctgtaactgcttaacgacctgatcggcaaaataccccttggcaatcgcaccaagatctaattgcatgccagattgacgcaagtagatactcgattgggcttcatctaggataacttcgtgcgtatctaataaggctaatcgttggctaattcccttggccgctggtacttgatgcccaccaaaaccaatcttccaaagtttaaccaacggtccaattagcacattaaaactatccgcatattgctttgtgtacttaatagcatccgacactagttgaaagcattcagtgctaaccaaaactggatgaataccggcatattgattgatcgcagctaattctgaatcggcacgattgacagaaaagacaccatccatccgctgcaagtaatcatagaccgcttcgaccgctaactgattcggctcaaataatgtcagcgagatgacggttcccatcatcgtaaattgtgaaacatactttttttgtgtcccaatcatcactctgacctcacgatttctttcagttatgctttaatttaacttcagatcttccaattccggccgtaaattttcaagtgcaatttgcccaggtgccgaagccgccccgaccgttgcaaatgataaacaagagccgaacacttcaccagcaagccgtgacacttttcctaagtcacccatcgacattgtgattactggctgtggtagtgtttggcgtgcaatattagtcgctgtcagtaatgttaagacatcctccaccgattgtggcatcacagccatcttagcaacgtcagcaccataatcgaccatactagtaaggcgcttaacgatctcagcaaccgccggcgttttatcaaaatcatgattactcatgatcacaactacttgatgctcatgagctgctgcaacaatttgcttaacagcttgttcgtcatggtaacgttcaacatctaaggcatccgtgaacccaccatctaagaccgtctcacacagtttaaaatactcagtatccgatattgctaattcgccgccttcaactttagttcggaaagtagttaataaggcaatatcacctaaagcctgacgaagttgctgaccggccgatttcaactgttctggattagttacatccttgaaaaaatcaattcgccattcaacgacatctggctgtgcagcctttattggttcaactgcagctaaaatatccgcaatagtttttcccgtaattggaacggcaatcttaggccgtcccgttcctaattcaatatcacgtaatttaacgattggtgtcatgatcaatcgtgacctccttttgactgttcttgccaaacaagtggtaatagcgaactgtaatgagtacagccaatacaaatccaatcaacgcaataataacgtcaaacaagaaaatgtttgcaagattagttgacatcatacctgtaactaacggtatcgtaaaggacgcaatcgaccccgctgtataaaaagcaccggtaatcgtcccctttccttgtgggaagaaggtggacatgactgtcaatcctaattgcataaccccaccagcagctgagaatccaacaacaaatgacatgattgaacacatcaaagatgttggtaccagatacatcagtagtaacgagagaaatgaaagtaaggtatagatgcctaagaattgaatttcttttacagcacgtttagctagcgcagccgtcaccagtacacaaacgattgacccaacactataataactgatcagtgctcgtgaacttgcatcgcccatgccggcaacctttgcaccatactgactcaaccattgactaactaagtagaaggttgcctgagatacataaccatataagataaatagcgttccatcaaaccataagctaccctttgattcagattgaactgtcttaccttcttctttcacagcaactttagcatcctgattagcaactgggaacttcccagcagccaacatgaatagtaagttaacaactaatacaacaatacagaagataaacgaccaaccgtaccaataattaccagcaactaagaaactaacgaataacggcaatccaaattgaccaacagaaatgaaggccttgataataacgttcgcagttccttttgaatctggaaacatttccattaatgccggataagtcccagaatcaaggaatgagttcgctatcccagcaagtatcccaaaaacataagccaccgtaattgaagggcttaatagaataccagcaaagaagagcaagtacgtaacaacaccaagaaccacgaatggtttacggccaaacttatctgatagaaatccagaaactaacaaaacaatcaaacgaccaattccaagtgatgaaattaccacggcaacaccacctgtagtcgtctgccagtgttgagccaaagcttccatgttttgggctaaaataataaccccaatcccatgaataaaatagtttaaatataagctaatggctgtcggcatatatttatttttcatggcaacccccgtctatttttgtgctgcagcgtcttcatcaaataaaatatggcgaatataatccactggcatatcttcaccagtccagagcttaaaggcagcagcaccttgttcgagcatcatacccaaaccattaaagacatgttcaacgccagcttcttgggcaaccttcattaacttagttgtccgtggtgcgtatacggtgtcgaacacaatcaggtccttacgtaaccaacttggatcatcgactaaagtcttgtcttctaacggcttcataccaacaccggtagcgtcagtataaatatatgaatcttgaatttccttcttaaaatcatcacgatcttctaattcgtgtaaagtagcatggcaggaagtccgctcgttgatcaaatcaacgttatgtttagcattttcccactctgcatcatgtaagttaaagattgacatttcactaactccgtccaaagctgcttgaacagcaattgcagttccagcaccaccggcacctgctaacgtcatcttatgaccacgaatattaattccttcatcgtccagagacttcataaaaccaataccatcagtcgtgtaaccggttaaaattccatcatcattaacaatagtgttgaccgcaccacacatctcagcagctgggtctaatttgtctagcagtggcaaaaccttctgcttattaggcattgaaacattagaaccccgcatatctaacgtccgaatcgattcaattgctgaaggtagctttttgttatcgatttcgaatgctaaatatgcatagttcagtcctaatttagcaaatgcattattgtgcatcgttggtgacattgaatgccgaatcgggtatgccatcaatccaattaataatgtgtgtccatcaatgcgttcagtcatgttaatccactcctataaatttatatttttaatatttgttactcaattcacttgtcatcttaacaaaatgctttaatataataaatatagaacagttgctaaatcgattaaattcttttatgaatgaaaggggtatcatgtagattgaatctaagacacttagaattttttaaagaattagcacggacacaacatatggcaaaagcggctgaaaaccttggtatctcacaaccttcattgagctatgccattaaaaagttagaaagtgaattgggggtccctttatttgaaccagatggtcgtaatattcgtttaacaccgattggttccgtgtatttaaaatatattacggcaagtttaagcgatttatcacaaggcaatgaactcgttcagcaattaatggatcctgacaaaggacatgttaaattggggtttacttatacacttggacagcagctagtccccgaactaatcactaagttccatacagatgataaaaatcatgcaattacatttgaactcggtcaaggaaactcaactgaattactccaagaacttgctgatgaaaagtttgatttagtgttagcctcaagtgtcgaacgccttggcgagcaacccactaataccttgtttgattttattccattggttcaacaagaaattgtggcggctgtccctagccaccacgcgttagccaaacaagaagaattattcgttaaagacttggaaccatatcccatgatatttttctcacataatagtggtttacgtcctttgattgatcgaattctaaggcaggcgcatgtgaaaccaaaaatcgtttacgaagtcgaggaggatcataccatggctggctttgtgagctataattttggcgttgctttgatgccatacttaccgcttttagaccagaccagcataacgttgaagcacttagccgatcagccactacgtcaccaaatatacctcatcagcaaacgtaatcattttgttacaccttcagttagtcgatttgaagaattcagtcgcagttactgttggcaacattacacacaacaggaacgtttaatttaggacaaaaaaactctcgggtttgcaacatgcattatcgccagactagtgataatgcgtgttatagacctgagagattttttactaagcaacaattgtcttcttttctcgcgatagggtaagaactacaacactgcaaagaacaccaattccagcaattaatacgtcaaaccacataatttcataaataccaatctgtgaaatccaagcggtaaataccggaatcgtaaatgaagctaatccactcgcagtataataaattcctgtaatacggcccttagcgcggggaaacgtattactcataacggttaatcctaattgcataacaccgcctgcagctgagcatccaatcacaaacgaactgattaaagctacccaccacgttgggattagcgttaaagctaccagtgctaacaacgataccaccgtatcaaacagcataaaccaaaccggcttaataatccgctcaactagtaaagcagttacaatcacgcctaaaatagaaccaacgctatagacgctgactaacatgcgagcgtgtactaaattcaaatgaatcacgtcactgccatactttgtcaaccattggctcactaaataaaaagttgccattgagatatatccaaaaaccgtcagaacacatccaaggataattttctttggcgttagtggtatatgcttttgcagagtgttctgctttttattaggcattgttactcgattagttgttagtcttggaaaagttcgctgacgtaaaaagctaaagttaactaccattaaaaacacacacaataaaaatgcccaaccataccatagttgaaaatgatctagtccagccacgataataggtaataataattcaccaatcgaagcaaacgctttaatcatgatattcgccgttgcttgcctttgaggataaagttccatgagtgctggatatgttcccgaatctaaaaatgaattagccattccggctagaataccgaagaaataggcaacggcaatgttaggagaaatgacaatgccaataaaaaacagtgtatatgttaagataccaatctgaacaaataattttcgaccaagtcgatctgagaaggtcccggctaaataaagcactagtaatcgtccaatacctaatgatgaaataacaagtgaaacaccagcatcattgacatgccattgttgacttaacacagtcatattttgggcgagaatcacaatagccataccatgaacaaggtaattaagatacaaacatatcgttgttttaatacgttctgttgatgtcatatgagttaatctttgcccttgtaaaatttgaattgagtaacaaagtgttttgctcatctattaacataatattttactccagatgtaagcgcttatcaattgtagtttacttaatatatttcaattttttcgaccactcaccgactaacacttaccaagatctgaaccaccaccatcaaagtcgccagaatatccaacacccagctgctccacacatagtagttctccattggccgatatttttggcgggttaccttgagatttttttcatataaccggttgaagaagataaatagccagataaagaaccacagaatcaggcaaaagacgggataaataaagatattactcttgatcccccacggcgtcagactcgtgacagcagttggcacgtaaacacgattaggtagcagtggatatgcgataattgccaatagtagcggtaataacgctaatcccgtctgccgccacaaattatagtgaccgtgctcatccttaatattaaacattgtgccaacctcccttaattaaccagttcatcgcaaatggtaattgatgattccagagccgccaatcatggtgacccggttgtaactgccattcaaactggtctttaaacacagccgccaactctggcttgaaggcttcatccattgaccgtaacatatcttgatcacccgtcgccattagaacacgtaacgtcccccagtttgtcggttgctgtaccaagtaagacaaatccgctggcgtcccttgcatctgtgctggtgagaaagccagctcaaggtctggcataattgccgattgttccacgtgaaaccttttgagatccgtcaccggtgatagtgccgcgacagccgcaaaccgctgcggataggtaaaggcataacgtaatgccccatagccacccatggagttccccaacaaataattgtcttccggtcgtgccgacaacgggaagatataacgcattcgtgttggtaactcgtgggtcaagtaatcccaatagcgtggaccatgaaccatattcgtataaaatccccgccccgtttccggcatgacgaccgctactcggtattgcgttgccagtagttcgatttccgttcgccgtaaccacgacgttgcgtccccacctaagccatgcaacagccacacagttggaagttgctgttcaccactactgtagtctggtaaaatttgtccgaccgcgttcactggttccggcaagataacttggacttgcactgactgtcgtaacacgttggaataaaagttattgctatgaattgacattgtgtgccactcctctctttatgcatcgatcatcgaattcggttaggatctaccgacttggaatcactagttagcgccagcccaaaatagttaggcaacatgtaactaacggtatattccagcgtttcttccccttgaaatacccaccgttcgatcttaatcaccatcgtatccagactcacgtgcaaataatccgcaattcgttgattaggaacgcaggtcgccgcatattcttgctcaaagggctggcgtgataaatcaagctgcgcatgtttcctaattagtgcataaatcgaatgtacggcccgtaacttcttcattgctgtggcaggaatcagcgtcgccaaataccacgactgcgaaaattcaaatggtgcgtgtctaatttcgcgtaatcgctctaaataccaggttgtcgattcagccgtaaacttagcccgtgttggtagtggcgtcgtctgattggccactaagattgcaacctgttcctcatcaacatcgtatgtatgggtatccgtaattcgtaccgcagtcccccgattaaatttggaaacaaagctgcccttaccctgaatacgataaatataaccctgatcggctaacatattcagtacccgcacgactgtcgtggaactgacttgatacttcttccgtagctcactctcgctataaaacggatcattctttcgaaaatggttcgtgttcaattccagaatcaaggcgcttaaaatggtttgataaattggctctttacgactcatggctgccccccttattattaacttaatacattaaatgtctatacttaatcaaaatttacccatatggtagattgcaaatttaatccgaatttttggacaaatttgnnnnnnnnnnacaagatattttacgctctcagtaaagtggatagctttctacatcagcagtaattccaattattgcataatggtgatctaagttctccaccttacgaaatactagtggatattttctaggcgtaatcgtaaccatttcattgtatgaaatttcataatcgaaatttctaccgaagtaattattataagattgataagttatggcagtacacataaatagtaatcctcctcgaaaataatatttagatttgataagccaataagcttacatctttttagtataatatcattgctgaaaaaataaagtttttttcatgaaatcatctctaaaataatttaatctattccaaacactttaagagtcaataatcaattgtaacccttatagccgatataacaatgctgttatacctacttatccttatctcgtgatttcttcaatagcctttgcaaccccatcatgttcattatcgacagttatttcatcagccacttgcttcacttcaggaatagcgttgcccatcgctactccatgtcctgcaaacttaatcatgctcaaatcattagcttcatcaccaattgccatcacattggcagcagtcaaacttaacttttcacagagtacttgcaaagcgttgcccttactaacaccattagtgttggcctcgtaataaaatggtgtacttttcgtgaaagtaacctgctttttcaacggttcaaatagtttttgctgtttaatggcagcgtctaaaacttcgggttcatcaacgtacatcgatttaatcagtttaatattccgcatctcttctggcgtccgatatgagatacccattgaaacgagattagcttcatagagtgtataatcaccaatattacggtcggccgtatacagccgatcctcagataccgcgtgaaaatgcaagcgtaacttacgtgctagggcttccaagtcaatataatcttcataactaatcggtcgttcatcaatcagttcgccactagttgtgtaggttgcagcaccgccaaaacaaacaacgtattgatcatcttgagcatcgagttccaactcctgcaacaatgctttaacacctgttaatggccgtcccgtgcagataaccactttaatcttcttttccttcgccattttaatcgcttgcttgactcgcaatgtcacctgcttttttgaattaactagtgtgccatcgatatcaatcgcaatcatcttaatattttccatcatagccatcctcattctttatcgaacacgaaatagaaaccgagcaacgccccgtttctatttcttcaataattattttaatttcagataagtattcacaacattagttacattaaagccatacttatcaagtaccaagtcaccaggtgccgaagtgccgaagcgatccacacctatcttagcaccatgatcgccagcatactgatcccagccaaatgttgatccagcttcaattgtcacccttcttgtgaccgcactcggaagcacactagcgcgatattttggtgattgttgcgcaaaccgatcaaagctcggaattgaaacgaccgcgacatcttgattatgctttgctaactgggctttggcctccaatgctaagttaacttcagaaccagtcgcaattagtaaaccatctggtatttctttttgagcagcactgaccacatagccacccttttcaacgccagcaaaggccgtatcaactgatacaggtaatgtcttcaaggcttgtcgactcaataccagaacggttggtttatcagttgttttcagtgcttgctcccacgcagctgaagtctcattaccatcagctggccgaatcacttgtacgttcggcatgcatcgtaaactagctaattgttcaatcggttcgtgggtcggcccatcctcgccgaccgcaattgaatcatgcgttaagacgtagataaccggtgcgtgttgtagtgcggacaaccggactgccgcacgtaagtaatcagtgaagacaaagaatgttcccccgaatacccgagtgccgccatgtaatacaattccgttcatcgcagccgccatgccaaattcacgtacaccaaaccagatattacgaccatcgtaggattctggctgaaagtctgatgtttccgcaatcattgttttgttcgaactcgacaaatcggctgcgccaccccataagctaggtattactttggcagcagcgttaatcgccttagcgcttgccgcccgactagccaatgcatctgttaattgatagtgcggtaaagtagatttcaagtcatcagaaaattgtccgttgaacgcttgcttaaaagactgcgcctgatctggatacttcgcctcatattcttcaaatagccgtttccattgctgctcagcacgcgcaccattttcctgaatagttacttcaaaccggtctgaaacagctgacggcacttcaaaatccgagtaattccagccatatactttttcagctgctttaatgccatccgcaccaattgggttaccatgaacagcattagtcccttgtttaggtgcgccataaccaatcaccgttttcacttcaatcaaagaaggacggtcagttgtcttttttgcaagttcgattgccgcgtcaattgcatcaagatcattcccatcttcaaccaccagatgctgccagccataagcagtgaacctgtcaccaacattttcagtaaacgcttgcgacgtcttaccatctaatgaaatgccgttcgaatcgtaaagtgcaattaactttcccagcttaagatgcccagctagtgaaccagcttcgtgcgaaattccttccattaagtcgccatcaccgacaattgtataagtgtaatgatcaacaattggaaaattaggtcggttatattgggcagctagatgtgcctccgccattgccattccaacggccataccgaagccttgtcccaacggaccagtagttacttcaacgccatcggtatgtccatactctggatgccccggagtccgactgtcccactgccgaaaatgcttgagatcatcaatcgaaacatcatacccggctaaatgtaacaggctgtataacatagctgaaccatgtccagctgaaagaatgaaacgatcacgattaacccaattcatatgtgtttgtgggttgacttttagatgttttgtccataacacataggccattggtgcggctcccatcggtaaccctggatgtccggaatttgctttttgaattgcttcgatacttaacgtccgaatagtattaacacccagctcgtcaactttatcaaacattatacttacctcctaagctgctattatgattacttttgcgttgcttgaaatgctttccaatccgaagcaaaactggccaaacctttgtccgttaatggatgagaccataacttaccgaaaactgcggctggaattgtggcaatatcagcgccagccaacgcagcttcttgaacatgttgtggcccccgaacactggcagcgataatttccgtcttgaatccataagtatccaaaacttgacgtaaatccttaactagctgaattccattgccaccaatatcatcaagacgtcctaagaatggtgaaatgtaagtagcaccggcctttgccgctaataagccttgcgaaactgagaatacaaggatcacatttgttttaatgccctcaccacttaatactttgaccgccttaagtccttcttcagtcatcggaatcttcaccacaatatttgaagcccacttaacttcattgcgagcctgggcaatcatctcttcggccttggttgccgttacctcagcggatactggacctgatacaatctgcgtaatttctttgataacggtttcaaaatcacgaccttcacgtgacaccaacgttggatttgttgttaccccatctactaaaccaagttccgcgaaatgtttaatatcttcagtattcgcagtatctaagaaaaatttcatgattagatttatctcctttattattagttttcgtaaattattgaaagtagtactcataattactgattacttagttccatcagtcatacgtttagcacgccgggtaagaaaaatactgcaaagaatcacaataattgtaaacaagataattcctgtaataactgctacacttccgtaactccctaattttcctaacaagattcctggaaccaaatagtcggtatctgcaaacgttgaagctgctaatttcaagcttcccaaaactggtaaaataaacaatggcaaccaactaatcaacaaactatttactgtagcgccaatgattgcaccacgccgaccaccagtagaattaccataaattgctgctgcagcaccacagaagaagtgccccactacacctggaataataacagtagttcctagcgcaatcatgataaacatacttagcgtcccaacaatgaaactgacaaagaatcctaataaaactgcatttggtgcgtatgggaaaataattggaacgtctaatgcaggcttagaattaggaaccaacttggtcgcaataccttgaaaagctggcacaatttcggccaaaatcatccgaacaccttgtaaaacaaccacgaaaccggcagcaaatgttcctgcttgtactaatgcataaacaatataattagtcccaccactcagtttcgattcaatgtaagctggacctgtcacaatcgccaaaataatgtagacaatactcatcaaaatcgtaattgaaactgtcgaatcacgcagaaagcccaaactcttagggatttctagatcctctgtagacttttctgcattaccaaaccatttacccatcaatcctgagagcgcatagccaatgttacccgtgtgtcccatagcaacatcatcgccacccgtgattttacgcataaatggttgtgtcaatgctggtgttaccgttaataatgtcccttcaaatagaccaccaagtacaatcgtttgccaacccgtgccaatgttagcgcttaccaatataactgcagttaaacaagaaacatataacattgcttgccctgtcaagaagatatacttaaagcgagtaaaacgagctaataaaatattaacaatcatcccaactaacataattagtgctgttgttgagccgtatttaaccagggcaattgcaacaactgcttcattactaggaacaactccttgcacatgtaacgcaaacttaaacatggaagcaaagggtgacaatgcattttgaagaattccggcaccaccagttaagactaagaaaccggcaaaggtcttaatagttccttgaacaacttccgtacttttctttttttgaagtagtagccctaacatcgcaattagcgctactaaaatagacggttgggtcacaataccaacaaataagttcaaaacagtcttcatgtgattctcctccttttcagcggctaatcatgttcaatattttcttgatccagaattgtattgacatggttccggacttcttgcttatcaatcaagctttttagtaacacaaccttattctcaggaatacttcctaatgcactttgaagcgttgattcaacaaagaagtaatctgctgaatcagcgccaacgctcccaacatcagaatgatccacttggatatcttctttaacattctcgtcctttaaaatactctgaatgttcatctgaaccataaaactacttcccagaccactttgacatacagctaaaaatttcataatagtatcctcctatttttgtaattcttgctcatgtgcaataacttctaaaatatcaacttcactagttgcatttaacatagctgtcaccgccgactcatcggttaacaactccattaactctttaataacggctaaatggctgttattatctaccgcggccaatacgaaccataaattgatggggtgttcatcattgactagactaatgctatgatttgtttttaagatagataatccgatttcatggacgttacccgctggtctagaatgtgcgagtgcgatttgtggtccgatattgatgtacgggccttctgattccaccacattgagcatttccttgatgtatccatcttcaatcgtcttattattaatcaatggttccgcagctaattcaattgcttgcttccaatctagccctgtgccttctgatacttgcacagtctgtttattcaataaatccaacagcatttttattcatcctcctttcttgatatcgctatttatctgacaatgaccagtataaacttgaataatagcgccacaagtgcaacaatgtttttgagaatagtgcaactttggcactttggtaccttaatgctttaattttttagtagacttaatacagggaggatactgaattgcgtgtaaatttcagcaaacgaaaacatggtaatgaattattagaaattctattaacgtcatcgggctacaccacagctaacttcttacaacaacatctacatatctcacgtcgtagcctattctatctaataaataaagtaaacgatgagcttgatcagcatgcagaatttccgattactaatgttaaaaaactaggatattaccttccaactgacacgatcaaatttctgcataaaatgacagaaaaagaaacttctagcaagatcatgaccaacaatgctaagcaacgccaactactaattgcatttagtatcctcaacactagtggttgctcgttagcggacctaacttaccaatttaatatttctaagaacacagttattagagatatcaaagtactacactcacaactagcgctatatcatttacaaatcaccaatacagaatccggtaaaataatcacgggttccccgacagcagttcgcaaatgggtgtacgatcatgctactcaactgaagacactcattgaacaaactaggcgggctaccattaagcccactaccataaacgaccagattaaactctttgaaagaataactggaaaatatttaaccgacgatgcaagtatcacaattcgactatttttatattggtacttaactaacattagagactgtaataaccaactaagtgatgttatatccgcacaaactgacttaacactggatcacatttgggctaaaagttttttgaacgattatcatatcgataactctaatgaggttgactacttagtcaagttgatcaattctagtcaatttgctcatgtcaattggaatgacgacttgattcaaaagttaaaaccattctcagttcgaatgatttctagttttacccacctctccggcgcacatgtttcaatcaagtcgattagtgacagtttaacggttcacttgctttcaacctactatcgtgctcaatataatatgccatttgaataccccgacttaaaaagtattcaacagcattatcaccacacttttgaaatcactcgtaaagttgtcgtaccatttgaacaatatattcatcacacactttctgatgatgaaatcgcattaattgccatttactttggtggtgctattcgtgagcaaaaaacaagcaccccaacacaaaatgaagtacttgtcgtttgttctagtggcatcggtaccagtcgtctattacttcaacaactagaaagccgttaccgcggtattcatttttctagtccaatgaatgtgcttcaatacgaaaactcagatctaagtaatgttcagcttgtcatcagtacaatcaaattaaacacccagcgcaacataccaataactaccgtatctgcttttccttccgagttggagtggaagatcatcgataatgctattattaaggctgggttggcaacttctgacacactcaagttatttaatgtggatacactattggatattgtaggcaactacgctatgataagaaatcctatgggtctgaaactcgcactcaacgactatttgacccagctaactcaggaaccactattagccgcaccccaagaaaatttatcagaattaatcaaactactgccgccagaacatgttggttttctaaatcatcaaaaatcttggaagcaggcggtgcgtacagcactgtcccccctacttgaagactatagtgttgaaaaaaattatatcgatcagatcattcatttaactgaaagtaacggaccatacatggttattgggtcaggcgttatgttggcgcacgctgctccacgtgatggcgttaataatctcggtgctactttctttttacttgataagccgctacctgttatgacaaatcaaaaaatggtccatgtaattattggtctagcccccatagattacgagaagcatctatcattcatcagtgacttgatgacacaattacaacaaaaggattggttaactaatctgtatcatttgaataataaaagggacttattcagatatttgtataaagataactagctcgtcttcatttcatttattaatgtatctaaaagcagaagccaagaaacgaaagttgctatcttggcctctgcttttagagttaaaaaggattttttattattaaataatgcgctctttccagtctaatctcatttacttactgaactattccaacgatatcattcggggtcttagcttgatatttcgcattattaaaatcgacattcggtaatgctccccatttagcaactacaaaatcaacgcctgcattctttgaagcctgcatatcaaagatactatcaccaacatacaacgtcctttcacgtgctaagttaaatctctctaatgtgtaggtaatcggctctccacttggctttggatttttagttaaatcagcagtagtcacaattggcatctttgcgataatcggaaaatgactgacttctttatcaaattgaacacgatccttagatgtaaccactcccactgtgagattcattgccaataaatcatctaacatttgttcaactcccacaaaatacgttatttcattcatattctcgttaaattcaattagatatctggctaatacattctgccaattttgaacaccaaattctctcaggatcatctcaccgggctggccaattctcttacgatattcttcaattggcatatcaacaccctcgcgaactgccccctccttcaataacttagcaattaagtctgctgaattaatcaaggtattatcaatatcgaacaagatattttgatacttcataaagaacccccctgctcccaaaaaagagcaccaagacaaatatctcagcgctctaaattaaggaggttataattttaatattctgtcattcaactacaattagtttagtctgctaaatctggatcatcaggattagaggcaatcataactttgagctctttaccggccatcattgcatcaaaagcgtcacgccagtgttcaagatcaaagaccttcgtaatcattgcatcttggttaatagcacccttgctttcaagatgtaaagcaatcgcccaatcataagggttttgtgaccgtgagccacgatacgtaatttcatgctgaataattgaacgttcatctaattcattcatcggctttgcaaaaagaccaacctgttggaaagttccacccttacggatcaatggtaatgcagagttaaccgctggtgttgcacctgaacagtcataaaccttggtaacaccaacgccatctgtcgcatccatcacgaccttggccaagtcttctttttgggtatctacaataatgtcagcacctaactttttagcaatttgtaaacgatcagcatccttagtgatcccagaaacaataacaaaggcaccaatttctttggcaatctgcaatgagagtagccccattggtcctggtcccataattaataaagtgtcatgtaacgtgaatggtgtcttttgatacatagcatgaacacaagatgctaaaggttccgacattgcagccatcttgtaggaaacgttatctggtaaaatgtgagcactttcctcacgagttagaacataatttgccattgaaccattagctttagttccgattcctacacggttaggacataaattatattctttatcttggcagtaaacacatgtgccatccgttgcaaaagtcgtttcactagtcacccgatcgccaggctttagcgttttaacatctggtcccacttcaacaacttcacctgaaaattcatggcccaaaacaagtggtgtcaccgcattggcatactgacccttaaatgtatgaatatcagtaccgcagatcccagtgtaggccacttttaataaaactttgtctcctgttacttcagggattggaatttgcttcagttccatattgtcgtaaccagattccgtcttaacgacagcctccatagttttagcgccctttaattcgtcagttttagttgtttttacagtatccataatccattttcctttctacggataatcctttaattaaataatggttgtactaactgtgatagtttcaaaattaaccagttcaagatgttaccacccgtatccaagttagtgacctctgatgcgccttttggaaaggcaacaataccgtgcatcattgatgtcaacgttggcccaaagtcagttgccatcaacaatgcaaataccattacgatagtagcagagagtacagagtggacgatatttcctttacgactaggaacaatcaaggcagcaaagaacggaattgttgctaaatcaccgaatggcaatacccggttaccaggtaaaataatggctaagaataacgtaattggtaccattaatagtccagttgccaaagtagctggtgacccggttgaaagagcagcatccattcctaagtaaatcttccggttcccgtacttctcttgaagtaacttttgagcaccttcttgaattggaattaacccttccattaagatcttaaccatacgcggcattaagaacatcacaccacccatggacattccaagcttcaaaatgttcggtacgctgtaaccacctaaggcagctagtaacatcccaatgacaatccccatgaccatgggttcaccaaagaccccaaaccgtttttgaattgtttgtggatccacatcccattttctgattccaggaattttgctgacaacccatccaattggaataccaagtaggccataagccgcagcagaaccagttggaaagctaatgccatccaagccataaaactcagcgacttttggcgcagttttatcagcaataattaagacagcgatttcatagataatcccgcaaagaattgcaaaccaccagtttttcgtcaccacataagccgtagccgcggccgcaatcatatgccagtaattccaaatatcgatatcaagtgttttagtaagatttaacaaaattaagccaacgttaacgactaaaataattggaatcatgatagctgagatcggctgtgcccatgtcccagcagaaacggcaggccatccagcatcaataatcgttaaatgaaacccaaaccgtttaaccatcgcctgcgcagcaggaccaacactagttgtcaacaaattgatgactaggttaatcccaatcataccgataccaacagtaatcccagatgtgagtgccttacccggtttaaccctaaagattaacccaacaataaagataataatgggaagcataacgctggggccgacattaatgatgctttgtacaacatcagataatactttcataatgcatcctcctgcttaaaaccctagctcttaattattgtgcttgaatttcgcgtgctttagtcaagatttcatcctgcaatttatcaacaccaagaccagttaaaaagcccattgctttaatcgctggaatcttatattcagttggtagtacagttgttgaaatcaacatatccgcgtcatcctgcttagaagcagcttcagcaatcttaatttgaatcaaattagcgtcaatattattttcggcaaacaaatcttcaacttttttcataacaaccgttgaagtggcaattccggcaccgcaagctactaatacatttaattttttcataataatctctcctcgtatttcttctatttatcttttatttgcttaacaactgatgaatttggttaaagttctcggcattttccaatgaatttactaatgaatcatcttgaataattcccattaatgcttgcagcatctctaactgagcatgtggtttattcagaccaagcacaaaaactaattttgcatcaaccttttgctctggatcatccatccgactaaaagcaattggagcatcattaacaaccacggcaacaaattctttgttgattgtatccgcgtcagtatgtggaattgcaacacctcgatgttccagttgcaagccagttggaaaagttgattctcgcttgattattttcggtaaaaattgatcagttacaaacccattttcctgtgccttcgcgttaatcgctgtaaataattccttcgacgttttaaaagaggtgtgtagaaaaataagttggtctctcaaataatcacttacttcaacaaggttctcactcaaaataagacgctcccttcgtatttatataaatgtaatcgctttcaacagtttaaattgtatcattttgcaaatcttttgcaatacttttctttaaaaaagtttttaacacccgtttgcaaagagtgctttgcaacgacataagcgttcgcaaaagcaagttaattatctcacaaagttcgacatagcgctctattaagcgcttacatgtaaaggatttagatagagatttcaatcactttacaaaattagattgcaaacaattgccaaatatgtgctatgattactaccgaaaaataaattttatttttacaaggaggccacctcatatggaagttatgcagcgtcaaaagtatattttagatcaattaaaccaacgtggtaccattagaatcgctgaaattagcaaggaaattaatgtttctcgtgagactatccgtaaagatatttacaaccttgataaacaaggactagtgcaggcaattcgcggtggtgctactaccccgcaaagtgtcaacgagacaaagtatggtaagcgtagacacgaagcagttgctgaaaaaaatgaaattgccaccaatgcactacgcttaattcatgatggggagtcaatttttcttgattacggtacaactgcttttcaaatcgccgaagaaattaaacatagccatctaaccaatctaaccgttatcactaactctactttcgttctcaactcgctacagtttgttaaaaatattcaaattgtactcttgggcggaacaatgcggactagtgaaggttctttgtccgggccaatcacacttgccaatatcaataatatctatgccgacattggtttctttggctgtggcggcgtcaaccttcaagcaggaatcaccaaccactatatagaagaagtggaagtttccaaaaagatgatgtctcattgtcgaatgaaagttatcttagctgatcacactaaattcgaaaaaaatgcactttacaagacagccgacgttaatgatgtggatgttatcatcaccgatgaacaattggacactcagattgccaaacaaattcgcttagccgacatctcattaattagtggcaaataaaaaaagacgattgggggaaaaccatgcccctaaccgtctttcttacttttaaatgccaggttcttaaattattttgccaatttcaccttgactttatgattgaaaccgttatcataataaccgtaatgataaataaaacaaaagtttgcaaaggagttgcaaaataatgagtgaagcaattaaatccaaaacagttgattattcttctgatgactatctaaaacgcgtcgatgcctattggcgcgctgctaactacatctcagttggtcaactctatctattaaataatccgttacttcgggaaccattaaaggcgaccgatgtaaaagtccatccaatcggtcattggggcacaattgccggccaaaactttatttatgcccatttgaaccgtgctattaacaagtatgggctcaacatgttctacatcgaaggtcctggtcatggtggccaagtaatggtttctaactcctacttagatggtacttatacggaaacgtatcctaaaatcacccaagacaaggccggaatgaagcgcttattcaagcaattctcattcccaggtggtgttgcctcccacgccgaccctaagacaccaggctcaatccacgaaggtggcgaacttggctactcaatcttgcatggtgctggtgcggtcttagataaccctggtttaattgctgctactgttgttggtgatggtgaatctgaaactggcccattggcaacttcttggcaagttaacaagttcctcaacccaattacagacgggacagtcttaccaatcttgaacttaaacggcttcaagatttctaacccaacagttctttcacgtgaatcacatgaagaacttgaagactactttaaaggtctaggctgggatccacactttgttgaaggtacagaccctgccaagatgcacaaaatcatggctgaagaattggataaagtcattgaagaaatccacgcaattcgtaagaacgccaaggataacaatgatgaatctcgtcctaagtggccaatgattgttttccgggcacctaagggctggaccggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaatcccgtcactaacggcggcaagttaactaaagacttaattacaccaaatatcgatgattatgctttggacaacaaggatcacggtaaggaagacggttcagacatgactgaacttggtaagtatatccgtgatttaatcgaattaaacaaagataacaagaacttccgcggttggggtcctgatgaaactttatctaacaaattaggagctgcgtttgaagataccaagcgtcaatggatggaaccaatccacgaacctaacgatgctttgttagcacctcaaggccggattattgactccatgttgtcagaacatatggatgaaggcatgttggaagcttacaacttaactggtcgttacggcttctttgcaagttatgaatcattcctacgcgttgtggattcaatgttaacccaacatttcaagtggttacggaattctcacgaagaaacaccttggcgggttgatgtcccttcattaaacgtgattgcatcatcaactgccttccagcaagatcacaatggttactctcaccaagatccaggtatcatctcacacttggctgaaaagaagaccgaatatgttcgggcctatctcccaggtgacgctaacaccttgattgcaacttttgataaggcgatccaaagtaaacaattgattaacttgatcatcgccagcaagcatccccgtccacaatggtttacgatggacgaagctaagcatttagttcgtgatggcttaggtgtggttgattgggcaagtactgataatggtgaagaacccgacgttgtcttcgcaactgccggctctgaaccaacgactgaaagtttagcggccgtatcaatcttgcacgctcgcttccctgaaatgaagattcgcttcattaacgttgtcgatcttctgaagttgaagaaggacgacccacggggcttatcagatgctgaatttgatgccttcttcactaaagacaagccagttatctttgcataccatgcttacgatgacttagtaaagaccatcttcttcgaccgtcataaccataacttacacgttcatggctaccgcgaagaaggcgacattaccacgccattcgacatgcgtgttcgcaacgaactcgatcgtttccacttagttaaagctgccttattagcaacgccagcctatgccgaaaaaggtgcccatgtcatccaagagatgaacagcatcttaaacaagcatcatgactatatccgtgctgaaggtactgatcttccagaagttgaaaactggaaatggactgcattgaagtagaacgataaccatgtctaaatcgtattcataagaaatgaaagaagctataccaacagttgtgttggtatagcttctttcatttctgatctatttctatttggcaaaaactatgctattgtagcgttaacataaggaaaccatgatgggagccaaatctatgagtattgtaactactgtcgaggagtcgtatccgacactctcacgacaagaacgcaaagtcgccttaaaggtcattcaagagccgaaagaagtccaaaaaatgacgatttctagtctggctaagaacgttcacgttagtaatgcgaccattacccgttttgtcaaaaaaatgggctgtgaaaacttttacgccttcaaaattcaattagccgaagggccagttgtccctgcaacaaccactgacaaaaaagataccgttgcggaccaggtctatagttactacaagaaaatactgagtggaacgtgggaacgattatcccccgacgatctccatgccgccgttaatttaatctccaaggctcgccgagtctatctgtacggtctgggtagctcgggctataccgcacaagagatgacccagcgcttaattcgaatggggattgccgctttctcgatgaccgacacccatatcatgtacatcagcggtggcatcatgcaacctggtgatattatcttggccatttctcttactggtgctacagcagaagtcaacgactcagttgcgttagccaaaaagaagcaagccaaagttattgccattacgtctgatgaacgcagtcgcttagcagaactaagtgatcttacgattctcgtaaaaaacagcaaattcgtcaacaactcgcgctttgttaactcgcaatttgccataacctacgctcttgatattatcgccgccatgctattagagaatgcgaagtatcgtgatcgaatgaatcatacgatcgatttaattacagataataaattcggtaaacgctaaaaaactaccatcaagatttcagctaatcttgatggtagtttttccgatttatctctgagcaatttgtgggtatcgctgcaatatgtcaacttcagttcgattaagtgcatggtcagcgcacaggataatcgctgcactatctagattgtgatgataaaagtgactatttttgacagtaaacaaaatgctatactgattcgctagccgcatatagcgccccatgatatccatatctaattgaccgttcaacaaaagctgatagtctcttggttgccgcaataccggcactagtactgacgtaaagtcatacctcagagcctgcttaaatgaaatttgaagttcaactcgttcgtaaaaggtccctaaataacggtgttgttcatctggatgtagatccggtacaccaaacattccattttgcaaacgagtacccaatacttcctcattatcttgcattcgtcactcctatttaaagtccacttgcgtcaaatctaacatttcactcaaccaacttagcactaacggaacccagttcgccgcacgtggctcaatatcttctgggtaattatatcgactagtttcaactgtactcaagcacagaccgtgttttccatgtgtaaatgtatgaatatcatactcgacatgatgcctagctagtgcttctgcgtacaataaactattcattgttggcactaccgcatccgcacaagtattccataaaaacgttggcggtgtctgatcagtaactaggttctgactagcccaatattgttcatctggactaattttaaaggcctcttctcgacttttcggaaaacctgccgccaagtcgataaccgggtaacctaagacctgcaagcgtgacgtcaatgggctatcaccaaagccgtgagttttgaggtactcggtgttattccccatcgcgttagttaatgctgcgacgtgactgcccgccgagaagcccatcaaaatcgtcttattcgcatcaccataatgtggtggtccttgagttttagcatactttaaggcagtcaaaccgacatcaattgcgttgggataaactggcccgcgatccaatagattgtattccactaccattgtctgatagccctgtgcactaaaagccaaagcaatcggttctgcttcacgctctgtcatttgaataaatccactgcccggaaaaattagaaggattggccatctccgaggatcataatccattttaagttggtctttccaatagcaggttaatttaaattcaaaatgttgcggcgtcattaatctcaattgctcatatttcattttcacacccccctaaatttcagtactattcttgctagcatataatgtacgtaaccagcccaatgccattggaaaccagttttgaacccgtgggaccacatcttcagggtgatgatagcgagaatcagctaaatcaccaaatgccaatccgtggacaccggctgcatagatatggctctcaaatggaacattatgctcacctagcgctgctaaatagaccagactattcacaactggaacaagctcatcagtccgcgttgcccaaatgaaagtcggcggtgtttgactcgtgactaactcttgcgcatgccagtaagattcatccgtagtcacagccatcatctcatgatgactagttggaaaacccattgtcagatcaatcaccggatagcttaaaatttgcgcaaatggtactagctttgtctcttcaaagccatgattatttaagaattctgattgagcgccaagcgctgtcatcacggctaccaaatgtccacccgccgaaaagccactgacaacaacgtgatcagaatcagcattcaactcctgcgcatgccgtttaacgtagcttaatgccgctaatccaatcgtggcagctgttggataaaacgggccatccgacgtaagattatacttcactacggccgcctggtaaccctttgcaataaatttaagtgctacagcttcaacttcccgctcagagtagcccgcaaagccaccgccaggaaaaatcaacgctaatggccactgtcgatcatccggaaatagcgtgaattgatcatgttgatagatccacatcgtaaatggctgtccttcgggcgtttttaaagctagtgtgcgtatctccatttccataacctccttaaaatctgtgtcaataacttgccttgaaacagattgagcacaaaatctcgactatcctcatgtgaagacaatcgagatttcagatttacgtctacgtcttgtcctaaacatcatgggttagactaataaccaagcgatattaatacaagatcgtcggacattttaattcttcttcacgtatgtttcattaattgttgaaacagtcaatccagtcacatcatgattaccacctgggaagagtaggctaacaacgtagctcaagacaaaagctgaaatgaaggcaacgcaagcaaccaataatgaagagatgtttaatgattgtacccagaaggacaagccgacacttaacactagtccggttaacaccccaaccgtattagcacgcttcgtaaagatcccaacagcgaagattccggcaattggcacaccaaagataccagtgaccgacaagaataagttccaaatctgtgaagcgttacccatcaacagataaatcgcaacggctaatcctaacacgcctgcaatgataatgattccccgagccaaggtaacatcattactatttttgaacttatcgttaaagaaacgttgtttaaagtctgtaattacacacgaggagatcgcgttgagactagaagcaatcgttgattgcgcggccgcaaagattccagcaatcactaatcctgcaaccccagctggcatttgggtaatgacaaaatatggtaccaccgcactcgtattgaatcctgctggcaaggcagctgtgtgttgatagaaactgtaaagaatcgtacccattccaaaaaataatggaatggtaatcaatgctaaccagccattagtgtacatagatttattagtatctttaatcgtagctgtcgtctgataacgttgtacaacatcttgactaccagtatattgatacaaactattaaagatttgaccagctaagatcaacggcacaaacttagatagattgccaatattaaagtcgttaccagagataaacttatgattggtaacgacatcgttaaccaccgtaccgaaaccacccttgatataaaagattcctaaaacacaaattaacagagcactacctagaagcaagaatccttgaataacatcgctccaaataactccttcaatcccccctaagaatgtatagagaatgcaaaggccaccgacaacacaggcaattagaattggattgatgtttgaaaccgatgtaatagcaataatcggtaaatagatgacaatggccacccggctgatatgataaagtacgaacagcaaactactaatggcccgcatgactgggctaaaccgttcttccaagtattcataagctgtcgttactttcaatttgcggaaaaatggaatgtagaatttaactaaaattggaataataattagaatcgaaaaacttccgatagcgtatgcccagtcactcaaaaatgcttgttctggagttgacataaaggtaattgcgcttaaagtagttgcgtaaatactgaaccccgccgcccaagcaggaatatgcccttctgctttgaaaaatgaatccgtgtttttactagcttttctggtaaaataagctccgacacctagcattgccaataagtatgctcctaagacaacccaattcagaactccaaatccaactttactcatgatttcgcctcgcttgttttatttaaactaatatgtgatacagctcgtttaccatgttgaataaatgttttaagcattgatggcgcaataagtgtcgccataacagtcaccacaatcattgccgtatagtgattatgatcgattaagcccgccgagacagcgacattcgcgacaaccagtgccatctcacctcttgaaaccattccggcgcccacaatattggcctcattccaggtcaatccaaacaatttaccgccaatggcaccaccaatttgcttgcctaaaatcgcaagcactagtaacaatccgataaaaactagatcgttttgcattcccttaaaggtaatttcaagaccaatgctgacaaagaatgctggaataaagacggcatacccaattggttcaaccttagcaacaagttgcgccttaaagcgtgtttctgaaatcgctaaccccgcaatatatgcacccaagacatcgctcattcctaacttaacggctaagaacgaaaaaccaaaacagagcaccatcgccgctgtcgtaatattctcagatgcattaaccttattgaatcctctcagaaagagtgggacaaaccacttagcaagtgcgattacaacgacgaagaacagtactttcggcaaaaccattgccacaagcgattggttgtgcgcactagcagtgccaaacaggcttgtactgattcccaatagcaccacacagataatgtcgtccgctacggctgcgcctagaataattgcaccttcacgtgtatttaaataatccatttctttcaatacttgaacggtaatgcttacagaagttgcactcaaaataagcccgagaaaaattgaagtcgtcagtgagaaatcgaacattcccacacaaagtaggacggccgatgccgttggaaagatgacgcctaatgtcgcaacagttaaagctggcttccagtagcgaaaaagcaatttcaaatcgccctctagaccagcaataaacattaaaataatgaccccgatttcggcaaagtactgaataaaagtactatacgttaagatgtgaaagactgcgggtcccgctaaaattccgactaatagttccccaatcacacttggcaagttaaaggtagccgcaatatgcgcacctaactttgtcagtaataagattaaaactaattgcaaaagatagttcatattattgaacctcgctaacttaatgcttgtttaaccaaatcaatctgtcccgataaatctgcagctgcaatattatattccagaaatactgggatttcgggtgacaactgacctaatagactgtgccaatccgttgccccttgtcccaacatcaccgttgtttgatccttgatatccttcaaatgaaatacggtgattgctgacttcaatgctgcaaaggctggttcaggctgttgatcaatccaataccagtttccggaatcgaaagtgtaccctaatgacaacttttgtgacttaacccaagcaacatctgactcaaatgtcgccaaatcaccattcgcattaggttggttctcgatcgtaacttgtatgggggtagttgctaacagctgagttagcgcttccaagtcatgtgcttgcaatgttggttgcacaccaaagctatacttcaatgatttgatatgatatttggttgccagttctagatttgtcactagacttgcgttatagccatcactgctaaacagttcctctggaaccgaataatagagatcccagtgttgttcctcacaaagctgactgattgctaacagttccgccgatcgcgtctcgggtttgaagaattcaccgcgaacttcaactgcactaacatcaaaacgagttactaatgtttttaagcactccagttgagtggctcctgcctgaacttgtgactcataaattgcggtgttaattccgatcttcatgatttagtccacccttcactaatttcaaaataaaaaaccgctacttaaaatcttgcaaacatgcttagaaaactgggctttaacactcagtaggcactgcttgcactattttttagtagcggttgaactgttcgaatgattattacgttatcaacttatcacataatacgataattgtaaacgctttctttttaaataaaaataattatcgtatcaacagccctgccatcgccccatataactgggctttatcggctaattcagccgtggtaatttttgttttaattaaatctggcggtaatagtggcttcaacgcattggtcagtaaatcgaccaaatattgtccctgtaacgatactgcaccaccaatcaagagaatgtcgggatcaaacaataataggattgatgctaatcccgtcgcaacttctgctgcccaatcattaatgatggcgacatacgggaccgtaccacgcttagcttcttcaaacgcatccttaacactcatctgatattttgctaattgatactcaagcgttaatgttgatgctcgctgttcataatttgtcttggtaaggggggcatacaatgtatagccaatcgaattggctgtcgcatgggcacccgtcataagccgaccatcttcgacatacgcaccgccaatccccgtacccagtgccacacaatatgcagaagttgcgcccttggcaccacctgctaattgttcgcctagcaaagccgcatcgacatcgttaacaacaaataccggtagaccagtttgcgccattaaagcggctttaattggtgttccctgataatctgagatcgttggccctgcgtattgaatcgcaccatctgcacccacaattcccgctgtactaacgccaatcccagctaacgaatactctgcttggtagtccctggttacacgctgtagttgctttaagatcaggccatcataattatgctcagtcaggcacttgccttcatgacttagatgtaatacttcgtcaatgagaccgtacttaatggttgttcccccgatatcaaatactaaatattgtgttgtcataattatcatccttgcattattatttggtcgaatcgttaagatgaacggcctaacaataccacaataattatttttttatcaactaaaaaagaaatttaatatcaggaaagcaacgattgcgtaagcgttttctttatataataataataattaccaaaaaagcgtgttgcaataatttttattagaagctatagtatttcctgtaagcggttgaattttgagatgattattacaaatccatcaaaaaataaattttaaggagttttatacttatgagtaaaaaactattatatgcagcacaaatgacagccttcgacaaagacggtaatattaatttagatggcatccgtgctctcgttcgctacaacattgacgtcaataaggttgatggcttgtatgtttgtggtagtactggtgaagccttcatgctgaatactgacgaaaagaaacaagtcatggagaccgtctatgatgaagcaaacggtgcgattgacttggttgcccaagttggctcactaaatctaaaagaagctaaggaactcgctaagtttgcgactgatcttggctatccgaaattatcagccgtaacgcctttctattacaactttacttttgaacaaatcaaagactactacaacgaaatccttaaagatgttgacaacaaattattaatctattccatccctgctttaactggtgttgccttaacaaccgatcaatttgcggaactctttgaaaatccaaagatcatcggaatcaagtacaccaacgcagacttttacttacttgaacgggtacgcaatgcctttccagacaaactcatcttatctggatttgacgagatgcttttgcctgcccttgcattgaatgtcgacggttgcatcggctcaacgtataacttaaatgcaccacgtgttcgtgaggaaatggacgcttttgaagctggcgatattgacaaagcacgtcaactgcaaaacatcagtaacgatatgattactgatttaattgccaacgacatttatccaacgcttaaattggtcatgaaacatatgggtgttgatgccggttacgttaagaaaccaatgagccatccaacccctgaaatggaagcaggagctacggcaatttacgaaaaatacttcaagaactaatctaatttatactagggtccgtcttaaannnnnnnnnntttcagacagtccctagtagaaagcggtcttttttatgaaaaatacattcttaaatacagttaagggatcattaattatctcgtgtcaggcgttacctaatgaaccactgcatagttcatttattatgtcacgaatggcccttgccgctaaggaagctggggccgcgggtattcgcgctaattccgttgttgatattcaggccattcaagacgaagttgatctaccgctcattggtttaagcaaagtcgactatcccgactcacctgtttacatcacgccaacaatcaaagagatgcgagccgttgctgctacgggctgtgccgtagttgcctgcgatgtcacgggtcagccgcgtcctaacggtgaaaaattggcggagattgtggccaccatgcgaacagaattccctgataccctcttgatggctgatactgataccatcgagaacgtcaaagtagcggataggttagggtttgatattattgggaccacgatgcacggctacacaccagccacgactggtgccaacattgctgataatgacttcgcctacttaaaggaagtcctccaagccacatcacgccctgttatcgctgaaggtaaggtggatacgcccgagaagatgaaacgttgccttgacttagggtgccacgcggtcgttgtcgggggcgccatcacccggccactcgaaatcgcacaacgcttcattagcgccttataattttagacattaaaaataaaagccagtcgtaagcaaaataacttacggctgacttttcatttgttactgaaccatcgttaatgatggtcgatttgtcctgacgtacattcacaatagcgcaaatgtctcatccagatactatccctcttgctctcgaatggaacctaccaaatcatccgtggctggagcgttcgcaagcaatgcgcgaacatcatcaaggttcaccttaacattccaaactaaaacaccaactaacttaccggcatctatgaaataaacaagcgatccatgcgttcgccgatcaaaaatcaattgcaatttaggatcaatattaccgattgcttgccaggaaatatcaaaaatcatggaatagaagtatggggtatgttgatagctcatgtgagcacctgccatattacggccaactaattcaccagaaagtcgggcgtggtccacgtgctcaatccgttgccgacccaagatgtgatctggataagaggcaatatctccagcagaccagatggctgggtcactagtattgagatactcatcaactttcacaccaccatcagctaaatccaaactactatcttcagccaaactaatccgcggcgtgacacctaacccaacaataatcgtatcggctgcgatcgccgtaccatcctttgtcaatagagtcaaatgatcaccttggcgttgatatgattggacaaactgaccactcatcagtgtgacaccattacgtttgaacgttgcttcatactcagcccgaatggactcaggaaatttaccctcgcccagcgctttttctggaaaaatcatcgtaactttagtcccattttgagtcagtgacgatgcgagctctgtaccaacatatccaccaccaatgatcacaactcgcttgttcggaccactaaatttacgtaacttgcgataatctgaccactgtctaaagactagcacatgtggatcagcaggtccctggatttgtcgaggttctccgccagttgccagcaatagctgttcatacttgatttgctcactatcagtcaatgtaatgaccttatcttgccgattaatagccgtaaccgttgtcttgaacttaaaagtcacattaggataatcttcagcaccaatccgaatgttctcttcagtaaactcatcatctagccatagctttttactcagtgccggccgttcatacggaacatccgcctcttgcgaaataactaagattgcgccctctggatcttcctgtcgaattcccttgatggcatagccagcaaccattccgccaccaacaatgacgtatcgatagttgtttgtctgatccaaatcactcatttaatcgcctccataactttactttttctaggaccattgtaatataaaaacgccatgattcgaaaaatgacgctcaagattattaatcattgattccttttatcagaacaataattttatttgcataccgtcaaacatctatcaaacaccgctgtgatcaaaattaagaactgctgctaacacaacataaaataatattatttttaattactcaacccaactttcaaggtaagcattctaaggaatgtttgatcatatggtagattgcaaatttaatccgaatttttggacaaatttgnnnnnnnnnncaatctcgggggttcacttcagcaatagaaaagttagacttatttgtttaacgattgtagcgcgtttcataccgtgttcaacctctttttgtagcatccatcgatattatctaagcctcattctatcaaaaacgtgtcgtttttctaacgccttaatgaagtaaaaaatagcaatcacctgtaatggtatctgaatgatgacgcgtgccaatcttcccaacaataacactttaaaattagtgccaaatagcactgaaattagccatgagtccatcatcaaactaacaaaaatcattacaagtatttgcgtcatcacaacggataaccaattgactgatttacgatataaaaacaaaccgtcaataaatccccctaaaaatgcagttaacaaaaaggcaatctgaaacgcgccggaaccaaaaatagtaaagcttaatatatcggagatcatctccaagagaccaccccaaatgggaccatatagataaccaatacaagccatagacaaaaagccaaaagataattgaaaatacgctggtccgatagcaattttgtataaaataacgtctaaggccaataagaaagccgatgtagacagcactaataaattcatttttggcaactgaaaaacatttttcgcaataagtttagacataggccaatcctctttttttgattttaatcataccctcattcttaataaaagtaaatattacttttattcgattgaaggtagtttaaaatcgtcgctcttgatttagttccttgaactcaatgatattactcatactaaaagccactaacaggtcaactagtacacccatcagtggctcattgtaaaattaatttttatccatgtaacttatcttgtaatttatcacccaagttatcaattcccttagcagtaagtacggtcccaccaataagaacaccacttacgattaaggttgcagctaaacaaaactttaaaatgcttttaatcatcgcaatcatctccttactaatccatccgtgtcagaacaaatgaggttatcgcaacaacaatcacaccaccaataattgaaggaacaattgccattccggctaattgtggtccccatgatcccaaaagagcttccccaattgcagatccaaccaatccggcaataatattactaatccaccccatcgatttacctttattagtaatagcacctgcaattgcaccaataatagcaccaatgatcaaaacccataaccaatgcataaaatccctcctagacttattaaaccgcttaaatacaataatagaattacacgaatatttaagccgattcataaatgattacttcttataattatcattttacaattatcgataatgatagacaaatataacacattatttaataaatgggtcgctactatttctcatgtgacgattccgggtggcctagaaaatatcaaacagcttgatagctgattaaaattaaactacgccacatgaacgattaacttaactgtgcataatgattgaagtcactctgttaaggtgttagcgtttaaattgtgcaagagctttcttgtaatttacgtgaaaagggcgattaaaatgacggaaaaattaacgacggaaaccggccaaccatgggctaacaatgaacattcccaaacggcaggagctcgtggtcccgtattaatgcaagactataatcttttggaaaaactagcccattttgatcgtgaacgaattccagaacgggtcgttcatgctaagggggccggagcaaaaggtttttttgaacttgaaaacgacatgggggaatatactaaggcagacttatttaatggtgtcggtaagaaaactcccgtaatcttaaggttctcacaagttgccggtgaaaaaggttatcctgacaccgttcgagacgtgcgcggttttgccttaaaattttatactcagcaaggcaattatgatctcgttggaaacaacacaccggtcttttttgtaaacgaccctttaaaatttcctgacttcatccattcacaaaaacgggatcctaaaacgaaccgtcgtacgcaaaatatgcaatgggatttttgggctcattctccagaatcattgcaccaggtcacttatttaatgggcgaccgaggtcttcctgcgtcctatcgaaccatgaatggttacggttcccatacttttaaatgggttaatcagaatggcgaacagttttgggttaagtatcacttcatctcagaccaaggcgttaaaaatatgactgctcaagcagctgaaaaagcaatgagccaagatttagattacttacaagatgacttatatgatgcaattcaagaaaaaaattacccatcatggacgatgtatgtccaaatcttgccatatgaggaaggtctaaactataaatgggacatttttgatgtcactaaagtcatctcccacaaagactatccactaattaaagtcggcaaactaactttaaatgagaatcccactaataactttaccgatattgaagaggcggccatgtcgccagcaaattttgttcctggtatcgaaccatctcccgacaaattactacaaggtcgcctattctcctataaagatgcacagcgatatcggttaggtgccaactttgaagatttacccgtgaacaagccggttgttccagttcataattatgaacgtgatggttacatgaaaattaataatcaaggtgctgaggtcaactacgagcctaatgcactgcatgggccagaagaggtgccggatgccgcactttcacctgattctgttcgtggtgaaacacgcgcacagccttatcgctatcaagttgattacacaactcaagcaggcgacctatatcgcttaatgtcagaacccgagcaagaacgcttaattaatactatcaaagatgcgttaggccaagttactttgcctggtgtcaaaaaactcgaaatcaagcaattttatgaggccgacaaaaactacggtacacgcgtggctaatgctctgggaatgaatattgctgatattatcagtgattaatattttgaccggatgttatccagcgcgatattatttttgttataaggtagattgtaaaattnnnnnnnnnnttaaatttgcaatctaccataaagaatgatgatgccgtctcatggttattaactaaagagcgacaggttagactcatatcgtgtaagtctagcttgtcgctctttaattaacaaaaaatcttagatatagcttactactcgaccatccttttattaataatgtgatcccctgtattaccatctagacgactcaacaatgcattgaactttagtcgccgaactggtcgtggaataaattggcgaatatcatcttcattaaagccaacttgaattttactatcactaatgatgataggccgacgtaacaacttcggatgatcacacaacaatttaagtgcctcattcaatggcatttcgggtaacttaggcgcaatttcaggatagtctttagatcgagctgagataatatcgtctacaccatgttcggttaaactcaaaatacgttttagatcttgcaccgtgggcgaatcaacactaaaatttttctccttgaactcaatcccatgtgcttccaaccattgccgtgcaactctagaagaatgacagcttgattgtgtatataacctaatcattcctaatctgcccctctctcgttaaaattcatcacagcgtattgatcgacattaacttctgcctgtcacaacatcctttaaactaaacgcattcgttactgtcatgaccaatccaataccccgtgaacacatctttattataggctctgaacaagggacataccgaccgttttaagacgaataatctgaggataatcgttttaagtacacttttaaacggtttaggaaagaacgaacccagtacacgtaatgctaacaaatatcactgcaatttctaatcgaataacgctgaattttcatcgcgtagcacataaaaagtcgcctactaatttaacaggcgacttccttggaactattatgactttttagcaagccatttagctagataacgattagcttgtgcagaacaaagcactttttcaccatttgtcatggttaatcgtcgcaagtgcttgtccaatgacttaatgcgtttcaagttaacaacatatgacttatgacacctatagaaattaggactcaaatcaggaacgtcctttaacagtccatagtattctaattcaccatcatccaaatggactacgattttatggggactggttgaactttcaaaaaatataatgcttttaacattaattgatctgaccgtctcaccaatttttatttgaacatagtcgtcttggtcattttcatcggtttgaaaacgatcttgcgccacgtgtaaaaccttgctaaatcgctcatacaaggaatctggaaaatccttaagaataaaatctaatgcctcaacttgatattgaaacaccatcaaagataactccgtgtgtgtcgtgataaaaataatcttgctgcgacggcccatgtcacgaatctggctagctagttgaataccattaatatctgaattaagggcaatatctaacacatagattgccttttgaggctgctgtgcattaaccttgtctaacaattcgtggggatcttggcatgctaaacagatactcatgtctagctgttgatcgacgattaccttagtaatgatttgccgtatttgttgtaattgtttcggatcatcttcgcaaatgtagacactaatcattctgagatactcgcttcaccgtcaagcgttgtaagaataccgctcctaagactctggtttcgagtatcatgttctcattgcgattaacaatcttacttaaactattcaatccaatcccccgattcttgcccttagtggaataacctgcctctttcagcttccataagggtggtaactgttcaaaaacattgttttgaatcaagaacaccgtactatttttttcgataaaaatggcactcataatctctccatcagcatgtcctaccgatgcttcgattgcattatccaacataatccctaatgcaatgtctaaatccaattcattaacagtaatgtcaattaatggttcctttaaatcaaaatgaacttcaatctcttgcgattgtgcatagctcaacttactaaataggatactcttaatcgacttcactttgacccgactcaaatcttcaagattatatttttcttttaacacccgatttgaaaccggtgcaagattcttttgataatattcttgtaaaccttctaaatcatcagttttcaaatattcatctatcgaaatcaacatattctgatagtcatgtctgaaacgtcgcaactcattatagtgagcttcgatttcattcatatagcgagtatcattttgtatttgtattctttgcttttggacttcatatttggctcttacattttttaaatattcgttataaatcaccaatactaaccccattacaactgacaatataattaaattacttaatataacctggaactgattttccagaccttcactcaacataatatacaagtatattatcattaataatagtgcggttatgcgatttaagctctgattactaaacgtgggactgaaattcgtgcgatccattacaatattaagaaaaattaagcttacgacactcaatatgacaaacactaccacatacccattaggaactttcattaaacgagttaatatatcacaaatatggtcaaccataatcgaccatatgaacacttgaaatgttatacatagtgcaccgcttagaactcgtacataccaccaagtgaaaaatataaacatcattaacattaaaaaagaaaaactaattcctaactttgctaaaaaaatataactcatcagcatacagacggataagaatataacatcaaaaagtctcacaaaaaatatatttctcaacaaagatttaattatcaaatagatagataattcttggaagacaatcattaacatatatctacactaatccttgctttttaattcatcaggaattttagtttcgaataatatcccatggcagcacataaccaactgtttagtacctacgtattgaaaaagatggctaagtactttatacattttttctttcataattttccctcctttcatagggcattagtaataaagcggctaatgccatcgcaattaaaatgattgtgccaaaataattattactaactatttgtaacaaactcaaaattaatgacaatccaattgcccgtcgctttaatttttttctcaatgacttcgatgtaataggattctttaccgtatcagctggagcaaaaatacttatgattattacaaatattaaacttaataacaatctgtatacttcagaaataccagtttcaatcacatacggcacacccacaaacacaaagatagttaatatcgtacataacaaatccgatttcaagtgacgtccataggcaaagccacgcaaaactaaaaaactacccataaaaactaacactgggaccaactcgtgtagcagcaacgctaagataatagtaattatcagcttaggaataacatttaatacagtatcaatgcctagtttaactagtaatgcctgccgtctttctagttgaagattcttttgaatcgcagcgaataaccgatcgcttaatttataaagcaatagtttttgttctggcttttccatatcccactcctataatgctcaaatacatacctgtatcaacagtttaaaacagtattaattaattgaaaagaatacataaatatattaattattcaatattgttttaagactagaaataaacatttaaagatacatcagtttaattattcatacgaaactaaagtttcatgtaaaaagatcgttaatataaatcagtttcatcgatactcccccttaatttttccttagattacaagtcaaactagacttaatttcactaattcacattactcaatagattaatatcaaatggtgaaaatcaacgaaaagaggagatctatcaagcaatctcctcttacataaagttatttatgaacactgatttaagctaagctgccgatatcacaatctcagcatccactaaatcagccttcaagtttttgacatctaagtggtcaaggtagaaatccgttaccttgtcacgaatttgttgttcaattactcgccgtaatggccgcgcacccatcgcttcatcatagccttgttccatcagccaatctttggccgctttagttacctcaagtttgatggattttttggctaacgttttttgtacatccgccaacatcaaatcgacaatttgacttaagtcttgcttagtcagatgtgaaaattccacgattccattaaaacggttcagaaattctgggcggaaaaatggtgctaacttatccattaatgactgatctcgttgcttgtcaccacttaatgcttcattaccaaagccagcattagaagtagcgataataatcgtatttttgaaattaatgacattgccttgtccatccgttaagcgcccatcatccatcacttgtaacagtaacgttaatacttgtggatcagccttttcaatttcatctaataatacaatggaatatggattacgccgaacccgttcggttagagtattagcattatcttcatagcctacgtatccagccgaggtaccaattaatttcgacacagctgtacgatcagcatattcactcatatctagccgaataatcgcatttttatttccaaacatatctaaggctaattgcttagctaattcagtctttcctacgccagttgggcccacaaacagaaaacttccaattggctgatcaccctctgaaaagcccgcacggttacgccgaattgccttcgctaccatttcaaccgcttcatcttgaccgattaccttacttttcagacgcttatcaagatttttcaagtgctcaatatcattagcgcccatatcagcaactggtataccagttaaacgttcaaccgattgtgccacatcatcaatcgtggcagtgattttttctttttgatccgtttttttaattttttgcttggtttcctcgatcgacttcttgatatcagcggcttttgtaaagtcctccgatttaacggcggcctccttagttgcctctaattttttaacgcgttgatccaatgtctcaacatcagtttgcgaatttttagccgctaaatgagccgcagtcatgtcgatcaaatcgatagctttatctggcaaagtgcgttgtggtatatattggattgaataatccacagccgccttcaaaacatcatctggtaatacaacatgatgatgcttttcgtacagctttttaacaccttgtaatatacgtaaagtgtcagcggccgtcggttcattaatcacaacatcattgaatcgccgtgccaaagccgcatttttcaaaatagtattgcgatattcatcttgagtcgtagccccgattacagtcagctcgccacgtgacaaagcaggtttaatgatatcagccaatcctttgccaccatcttcaccaccagtggcgcccgtgccgataatctgatgaatttcatcgaagaatagaataatattaccagctgctttaacttcctttactagctgtttaatattttcttcaaaagaaccgcgatattgagttcctgcttccaaagacgataaatcaatcgaatagatttctttatcttgaatcgtttctggaactttaccagccacaattgcttgtgccagaccttcgacgactgcagttttacctacaccagcatcaccaactaagattggattatttttcgtcctacgactcaaaatttctgcagtttcttgaatctcattctcacgtccaatcactggatctagtaatccatcacgagcctgttccgtcaaattagtccctaacttttctaaaatccccccttttttaacagcctgtttaccatctttagatacttctattgttttattattttggggtagcttaccagttgatcggtattgagcaaactcatccggtgtcagcgattgtccattaactaaataccgtgcacgctccgaattttgattatccatgcgccgaaataattgattgaaaacatcatccatatcattgttgaaaaaaggatcatttccgtagaaatttgccatattacaacacctccataaaaatttatatgtgtaacttagtgaccataatatcctttaaaactacaactgaatcgtatcacgatttttatgtatcgttaagtaaagtgcttatagaatcaattagaaataattagaataattttgtttaaacaaaagagaaatcaatttcataaaatgaattgatttccctacaaggttccctatttaatagcccttgataaagaacttgaattaacaagttactttccagaccaattttaatttaagagactgcgactcaaaaagcacacccagtatcaagttaaggccaactagttatcgttaatattgccacttaaatatcaatactagcaatcatgatacacgtgtaaaatcataaaccaaaacatattacatgacgtaacggcggtcttgggactgtaaactcacagtaatgattctattgagttggataaggtgccgatgaccagtaattgccataaatgcaattgctttcggtacaatcgtagtgacatagccaactgtctcggccatctgcccatttgttttataaaaccgtaatgagactcgacatttttgatcatgcgcttgttgtaatttacaataattattttcaacactcaaattaaagtctcccgttcaaagaattcaggtttatttattcgtcagtgaatctatgtgtttgtttttctcattgttgacggcgtaagtccacattaaggagtcagctattcagtaaaaactaaataactagtattcatgttcagctcagtataatatgcattgatggttactaatcaaaaatcgatctctaaatatcctaattactatgaaactttgaagttaatttatgagaaaaataactcacaacaaaactcatgattacaaccttgtcatcataactagattatgaaacattcagcctcctaaataaaactggtatgcgcgcatgtgcgcatgtgtacagtatactattgccaggtatgtctgaataaccgttttaagacttgaaaaactcagctgggtgctttaggacgctttttgtgcattttaagacaatatcctaacttcaacgccggcatagcttcaattcgtcaatcagtgtcttagttcccgctagttgcatatcgatcaacagctcatcattaaggtgactcactacggaagcgacaccctgcgcaccacccaatgctaatccatagataatcggccgagcaagtgccaccagatctgcaccattggctaacgccttaaagacatgggagccacgccgaacaccgctatcaaaaattgttgggacgcgcccattaacggcttgcgcaatctcgtgtaaaacatcaaaggaagctggaccaccatttaattgccgaccgccatggtttgaaacatagataccttgagcaccagccccgattgctaacaaggcatcttctggttactgaatccccttcacaataactggtaaattcgtatattctgtaatacgccgaacatcagctgggctaatcttttgcgccgcagcagcatagatttctatgatacctttccctttaccatccccttcgctgaacttagtcaagttagccattgggattggaaactggaaattgttgataatatcagcttcacgatacccgtcaactgttgcatcaacagtcaaaatgattgccttagcaccagccttcactgcttcatccaataaactctgattgaaattccaatccttgctcatatataattggaaaaattggggcgcacctttaccagctgcggcagtatccgcaattgacgttgaagaataagtactctgagccatgagtgccccaacttgagccatcccttcagcagtcgcagcttcaccccgtgcatgtgccaatccttgagcggccgctggagccatcataataggcgttttgagatctatgccaaaagcctgagtctgtgtgcttggctgttccatatccgtcaatgctcgtggcacaatttgaacatggttaaaggccattgtattctgctttaaagtccattcgtcttctgacccaccactaatatagccaaagcctccgctcgggatgatctttttagcagctgcttccaatgatggtaaatttaaaatcgttaacttttgctcacgatcactctgttcatatccattaataactgtcattatactaatctcctttacataaccctttataattcatttaataattggctaagtgccggttgatccgcttcagcgataccatatcgttcacgatacttagcaatcgtatctgcatcaaagttttctggatctactggaacaaaactagtatcaattggatcaacatttttaatttttgcatcaatcacaattggtagttgattaccattctgctgtagttgagtaactttctgaaacgttgctttcaactctttaaggttagtcactttaaaaccaatcgcacccatgttgtctgccatcttggcccaatcagcaccaatcaagtcaatcccatacggcgcctgattagcgagtaacttttcatgttgaataaagcctaatactttgttttctaaaaccacgttaatgactggcaaatgatatttaacttccgttagtaagtctggcatcaccatggcataaccaccatcaccagaaatactccaaacctgcttcttaggataattcaattgggcggccaaacctgctggcaaaccaaaacccatcgtgccataccaagccgacatcgtaaaagtctgttgcttattcaatggtaactgtcggattgcccattccgtattattcccaacatccagaccaaagacggcatcatcagtagcattgtctttaatagcttctagcaccccttcagccgtcaaccctccttgatcatcagtagcaattgtcttgagccaccggttccagttttgcttatcacgttgagcagctttcaagaacttagttggcttaattgtcacttcggattgaagtaatgcttggaaaaattcttttgcatctgcaagaacagtaatatcagcatcatgttgtttgcctaaatctgctaaattattattgacttgaataaacttaattccttgtggcaagtaacgtgcaaatggaaagttagtaccaacaaacaaaactagatctgccgcttgcgagacttcaaaggcgggtttagttcctagtcgaccgcgagagcccatgaaattaggatggtcagttggcataataccagttgctggagccgtcgacaaaaccggcaaactaaatttttcagaaactgcgataacttcttgacgcgcattataggcacccttgccaatccataaaacagggtgttgagcagctttcaaagccgctatcgtctgctgaacgtcatctaatttcggcattaagacctgttgactgccgctaagtgaagccgttttaaaaccatcaaactcaatatcttgaccagacaaatcatctggaataataacaacagaaaccgaacgggtcgcgtatgctgatctaattgcttcatcaaccacgtatggaatctgttcagccgttgtcacttgtttatgaaattcggctacatctgcaaaaattggatcttggttcatttcttgaaagaagttcgtattcataatggatgttgctgattgaccgactaaagctagcaccggtacgtgatccatcttggcatcgtataatccgttcaagagatgaacggcgcccggtcctgctgaaccaaagctaacaccaatcgtcccagttaatttagcatctgccgcggcagctaaagcaccaacttcttcatgacgtacttgaatatacttcaagtggtctttctcttggtagaacccatctaccgtgttattaatcgagtcagctgtaataccatagatatgatcaatgttccagtcgactaacacttgtgccaatgcttgtcctgctttaattttagtcatttccattaccctctttttgttgttacttttttgagcacaactatatcctaaataaaaacttgacccttgtcaagtctttatcttaaattatgcttgttgttgaacagcgctaatgtcatcaataatatcttgcagcgtcactcgcgacatacgtgcctcagcactattctgaatatcacaatagtatttttccatcactcgcggaattaccgacccgaccggacacgtctccgaagtattatgatcaacgtttaaaaaattacgcttagccaccactgctacatagatatctttcaaggtaatatcattgggcgaacaagctaatgttggtctagcaacgccacgaaccgaagttaacaagcctgcttttcttaacttactcatcattcttctgaccatggtaggatccgtatttaaactactagcaatatgctcacttttcagctggtcatcagtatgcaacgcaatatatgccataatatgcgtcgcatcacttaattgtgtattagccatctagacacctcccatatccatctctattgttacttattttagcacatctaacatgaacataaaagcgattaaggaaataagttaggcttctttccctaatcgcaacataagattatttgataatctccattaattcaatcaaacttattcaagacatcgatagtagctgaatttaaaacccaccctgtccaatttgatgttgcaaatcatctaagccaaattgttttaaataagttgaaagtggttgtaaatcttgagcttcataccgttgtttaaatgcttcaatatcagctgccgaactcgttgccgaatctaaacgaagcttttcagcaggcagtggccgatctcctgtaatcaccgcatcaatcagaactggttcatgctgagcgattgctttggcttgttcaaaaacatcaggtaattgctcaatcttattaactcgaaaagcttgcatgtgcacgccatcggcaatcttactaaaatcaatatcattgaattcaacgccaataaaatcattctgattagtatcttcctgctcatctttgataaatccatattggcagttggtgaaaacaacattaatcactggtaaatggtattgaacttgcgtcgccaaatcttgcatggtcatcgaagcgccaccatcaccggccagattaaacacctgccgctcaggataattaagtttggcagcaattgctcccggaataccaactcccatcgtagcaaataagttagaagtaatgtgccgattggacggcgttaatttcaaatgtcgattcgcattcaaattgatatcaccaacatcaatcgaatagattgcatcaggctccgcaattttattaaccgcacgtagcacttgatatgcttgtaaaggcccttcctgcttatcttctaatgaagctagataagcccgccaatttttaacattggctaaattggcttgccaccaaggtgtcgactcccgttcagatacctgtgctaaaattgcagccagcgttttttgtgcatcagcaagtaccgcaatatctgttttatgtcgtttacctaacttagctggatcaatatcaatttgtaagaaataacgcgtatttttaaacgctttggaaacttctgcaaacggataattattaccaacaaataaaacaacgtcggcttgcgcaagtgcctcattcgccggtttttgtgccacccgattagcagaacccaaataggctggataacgatccgcgacaatacccttagctggatacgtactcattaatggaattttcaacgttttactcaattgttcgagttctttaccagccttacgagctccaatgccatagtaaataagtggccgttcagctgcgagtaaagtctgtgtcaatctcgtcactgcttgaacgtcgggttctggtaataacggcgtttgataactattagcggaagcataccaatcttcagctggaatctgttgccatggtaaatcgactggaatttgcacaaccgcaacaccttggtgcgcgtaggcgcgtcgaattgcttcgtcaataacatgtggcaacgtggcagcattgacggctgttacattataatctgcaacgtccgcataaatcggattctcattcatttcttggaacgtatccatgttcatcccagtagttccaaattgaccaataagtgctagaacagggacatggtcttcacgcgcatcatataacccattcataagatgagtgccaccaggtcccgctgagccgaagcaaaccccgattttacccgttagcttagcatcagcagcggcggccattgcaccaacttcttcatgccgtacggtagattgtaaaattaatccnnnnnnnnnnttaaatttgcaatctaccgtacttgaatataatggattcgatccctttctgctgataatgcgtccataattgaattaattgaacctccaggaataccatacaaatgatctactccccaagcttctaaaactttaataactgctgcacctgctagtatgttagtttgttttgtttgtttcataaccataataaagcccccatttcatgcacaatttaattacgcacaatttaataaacgaatattaccatagcaaacgcttacattcaagtggtcataaactcatgctttttaccacttaatcacgattcaaacgcattgtagatcaacaacagcgctagtctgcttgccttgatgaaccaccatcgctgttgacagttagtatctcatacattcattttttaaacaattttagtaattagtgtatgttttacaggggcatacttccaacaatgtctgcatgtttagaagctagccattcttcgaaaactaactaccgctttcaaaacatgaccttaactcaactcgacacagagcaaaataacatctgccaagttaattattcagctataatccgtaccacgctaccaactttaaaatcaggataatcgccctgctcaacatataacgtcccaggcaatttagcctcctttgcacccgtaaaactaatagccgtatggcctaatcttccaaggttagtctggacttcaccaccaactgctgtaatttgatagacttgattgtcgacttcaagtttcattcctgctgtgatttgctcacttattgggacaacttcgataataaagcaagaaggccgtaatgcgtctggagcttcatcaccaaataatactgccatgccaatcgatttaaaatcagcagattccgcacctatttctaagacctttgttgaaaagataattctctcttttgtcatcatacaatacacctcaaaccttctaaaaatttattttgaatataatccaaaacttgcaatccaagcaataaagacccgcggaacgccgttgataaaccgactatataacactgatggcaccccaacttcaaccgtcttagaatcagcctcagctagtcctaagccaactggaataaagtcacaaccattttgcgtgttaatcgcgaataatgctggtaatgcatactgtggtggaatattacctttcccgatttcaacgccaatcaaggtcccgataacttgaccgataactgcgcctggcccaagcaatggagataagaatggtaatgagcaaataaatcctaaaaccatcaagccccagacattgcctgctaacggctccatgacactggcaaaaaccttaccaattccagagccattaataatcccaataattaatgccacaaatgccataaatggaataatagtattaataactgtttgaacagcatcttttgcggcctgattaaacgtcgaaacaactcgcccagcaccaatcccaatcttagttaagatcccaggattttttgtttgtgctgttagtgtctttgtattatcgaatttcgtatcgtcatctacatcctcaaattggttagcgctttcattttgactatcagaaaattgcgcctcctcagatgttaccaacataatctgatcaacatctacattggaaacataattagcttcattcataaattgcgctaagggaccgctcttaccagtcggtaatacgttaattgttttgatacccttcttgggataaattccacaccttaatgtcccaccacagtctacaaccgctaatgctgtttcttcatcaggaattgacgtcttaaagccatcaacagcttccattcctgtcaacttagcaatcttatcaacaattgctggtttattacctccagtgacataaacaaatttatgcttcgtgatagttggtgtaataattagcgggccaccccagccaccagagcctttaacaactttgatactatgatattcctttgccatgatctcgttcctcactctctcaattagccgttaaattcaactttcttggacaaggtaatcccttgttgtttgcagacataggctgttgtaaagtcagtaatccaaccaccgataaagttcattactaggccgactaatagatatcgaatcgccaaatccattgtattcaatcctaacttctgaaccccttgcgcaatccctaaccaaatgaaatactcggaaggattgatatgtgggaataccccattactagtgtggcaaaattgagcaatcgatgcataccaactaggtttatagtattctggcaagaaccgtcccattgagtgcgccataggattaccgagcataaatgccgaaacaaacggtaaaattaaataacgggttacaggattctttgacgaagctctggccaacttggccatcttcttgtcaccaacaaaagcaataatcgcgttcatcaagactaacagcaatagcacaacaggaataattgatgtcatccatccaattaatgtcttaccaccgctctgaaacagccccataaagcccgaggccaaatctgtgactactttcatagtattaatgctcctttacgttcacttgtttttttcgcaaacttgctaagcctttataataaatagatttcagcttttcaatcattggtaggctccaaattttgacactaccatcgaaatcttgtggcgttagctgatttgctttgtaatttaaatagttcttataggcatccaatagacaaactcgcgttagcttatcgaattgttttaattgctggtatgaagcagcaatttccgcaatatttttctgccgcagttgatgcaattccctaaactttgcaaaaatcgtaacccccttcatcatttgagcctctaagatcgtgccgtcatcctttatcgctaatagaattagtgtccccgaccgtaattttttaggatttttgccaattgctactggcgctaacactcgtaattgatgaaaggttttagaaaaattcttaatttgtcttagtccaaggaaaccttgtaatagaaacgcactgactaggatcacgccaaaataaattaacattaaatcgcctccatcaactgatttaatccttgattttcatcataatttttcaagttattataaatattgctgttagctgtgatactgcgaattagatcgtatacttgtgctaatattttgcttaatgttgcatctagtttatacggaattgcgaccaaaaaaaccacgtttaccttttgattatcgaatactaccggtttttcaaacactcctactgttacaaggattcgatttagtccagatttatcaataacgtgtggcaatgcaaccccatcaccaaaaatactactcgattgttgctctctattaagccaagcttgcataaaatctggtgtcagttaaccatgttgtatctcttgattaattaattttttcactccagtgacgtaggtctcctgttcctcaaactgcgtgacatcaaatcgacactgtccctgattaacagcttcatcaaccaacgaaatttgaagacgttcacgtaacgttccttgattaaaaatagaattcaaccgaataataggcgcgtggttaattaattcattatctgttaaaaaactgttagaaaaaatcagtaaatatttttctggactctgctcccattcactaattgagttaaaaacatcaatctgcaaatcatcatctaacatttctttcaatttctcggaaataaactttttcatactagtattaatgggctcaactagtgcaacccgatgaataattggcgctgccatgtattcttcaagctccatctgaaaatagactgttaaataaccaacctcctgggaacgaatccgaatattcaatttagtggcaatggttgataatgttaattgcgctaactccgttgaaactggatacttacttaacatgtctaccgagataaatccttctgacttgacatcaaaaatagcccgattaatgagaaataataaatgatatcgcaactccatcaacaaccgtttaaagtccaaattcacatctaatttttgcttaaggattggaaaaaccgactgcattaaatcctcaacttcgaccaatcccacttgaactaactgattatcatccttcggtagctttctgatgtttaatgggtatgaaataaattcccattcgctagtgcttaacgagctaccaattatctcagtaactagattccgcaaggacgccatcgttacatcactaagaagtggatgatagttattaatacgatcattgatttgaatgttatatttacgtaaccaattaacaaccgcaatatttcttttaatcatggtcacagtatcattattatgatcaagttttttaacaagattaagcaatttgacatctgtcgctttatcccaggttgcttccagttcgtagtatttcccgactaaagttcgtgtaattactgcatacatataatcatgttcaaccgctaaatgaatcccacgattagtttttgtctcaattctgacttggtaataatcaagctgttgtttgagcgcttttaaatccttattgatagtgccacgactcacagccaatgattctgccaaatcatccagaataacgtaatccgtgaattgctgtaacaattcttttaaaatcgttgcttgtcgctttgagggatcattgaaatctaaatcctttttcaagaaattagtttgtagcttagccatggcagaataattattgataactaggtaaaacttggcttgattaacgttgatttttgcaatacccaccaaataatcattgattgcacgaatattcttggtaattgtgactctcgaaacagaaaaatgggattgtaattctcttagtgtcaatgcatcattattaataaaaaagtttaatatttcaaaactttgcctatccattgcctcaccatgcccccaactaaaatttaaaggttaaccacgactcttgcctcccgcaacgttaatcgtaaccccggtaatgtaactggcacgttctgatagtaaatagttaactgcatccgcaacttctgatagtttgccactccgaccaagaggtgtggttgacgtactcttatagcctgcccgaatgtcatcaacagttttatgccgggtataagctaacgcctcttcataagagcgtgttcttagcccagtagcttccataatacctggcgcgacaccaacaacccgaatattatgttcacctaattctttagcccacgaacgagtgaacccattaatcgctcccttagttgctgaataaacactctgtccttgtgaaccttcaagtccagcttctgaggacatattaacaataacaccgtactgttgcttctcgaattgatgggtaactgcctgcgatacaaggaagacgcttttcacgttcacggcaaacattttcacaaaatccgattctgcaaattcatacttaccgtgaggatccttggcgtcagccaataaacgtggcaaattgataccagcattatttacaagcccgtcaatttttccttgttcatcaacaacctttaagaccagccgattaaccgcttccgcatctgtgacattggtttcaacaaagtgtaaattatcattttgctgatcaccttgattgaggtcagcattataaacaatcgccccgttattcaataattcagttacaattgctttaccaataccggatgagcccccagtaacaacgtataccttacccgaaatattaatccatgaattattcatcaaaatcgctccttaatcatttcttttcttcacagataaatatatacgaaagcgcatacattattaatgcactcttttttcattggctttttaaattaatggactaatgattcatcaaacatttagatgtctgatataaactataaatattatgccgaattattttcattatcgccatatcataaagcaaattttgtaatcgaccattgtaatcaataaccgtaaaaatagagtcgctttaaagaagcgtataactccttcaaagcgactctattaaatagtcttgtagccatattaatttgttttaaatcgtcaccgtaacagctgctgccgcaataattagtatcagtccaccaatcgtgacccacatttctttggtagtcttcttttggcctaagaaccaaataccggttaacgttgccaatacaacggaggtttgtgaaagaataaagccggttgctaatccgttcatatttggttgcgcagagattaagtaagtcaacgccgcaaacgcgaagaagaaacctgagatgatgtgcgtgtatgacaccccttcaacgagggctaacttttcacctcgtgatgctaagaacagggcatatacgatcgaaacaataaccatcccaattgcttggggaacgaaggcttcctccccaccaatattggttgcttggggcgcagccgaataagcccagtacccgatttcaccaactgctaaccagataacagcttggcgtaaggtccgggcgttacctgcatccttatgttcagaccacactgttagccaggcaccaatgataattccaactaaggctaggccacccaagaccttgtccattgccccaggccagtcacctaaggcgaagacgccccacagtgatgcgcccaacagctggaaggccgtcgtaattggcattgctcgtgaagaaccaaccatcgtaaacactttaaatgtcacgatttgggcacttgcccaaccgatccctgatagaattgaaaaccagagattcatgccgcttggaaaagcaatcccttgcacccatgcataaatcagcgcaaagattaacgttccaatagttgaacccaagatctgattaacaggccgaccaccaattttcgacgcaatcgtggggtaaagtccccaaccaagtaacggccctaagccaattagtaaagcggtagtattcattccaatccctccattaatcaccaactactttaaaaagtaacgccactttccaatagaatatttgaataaggtgtcatttcaccagtccgaacaaaggccttgcagtcagccaagtccttcttcatttcttcatgtggaatgaaggtaattggggtgtctggtaagcgcttcttgatggccgtcaacatcttaggattttgaactttaatttcttctgccaaatagattcgttgtacttcaagctcttccaagacgttattcaagacttgcataaaactaggaataccattatcaacggctaaatcgattttttcggttgaacttggtactggcatgccagcatcaccaatactcaacttatcgaaatggcccatcgttgcaataactcgtggcaaatctgaattaataacttttgtttttttcataattatttaccctccgcggctgtaatttcatttttataaggaattgatggttgcgcaccgaaacgttgtacggcaatcgatgacgcccggttaccatagcgaatcgcatcttcaagattactaaaatctttatttaacacactactcatcgcgccaataaacgtatctccggctgaagtcgtatccacggcttcgactttaaaagctggtacgataccatgtcgcccatcgatatcataaaacgcacccttactaccaatcgtaatgataacagctgaaataccgagggcgtgtaatgcagcggacgcctttaacatgctggcttcatcggtgattgcaatcccagtcaaagtttccgtttccgtctcatttggtacaatcatgtcagtaactgctaaaagttcagcggggactttttctatggctggagcgggattcaagattgttcttacgccagcggcctgtgcaattttaaaggcttcgaccgtactatcgacagcgctttcaaattgtgcaaccacaaaatcactagtttcaatgatatcacggtgggcttcaacgtctgctggcgtaaaggccatgttggcaccaccatgaatcataatttggttttcaccggcatcatcaaccgtgacgtaagcttgacctgtcgattgattagtcatctttgtgatccctgccaagttgatcttttcctgcgtcaataaatcaagcatggttttaccagcagcatcgtcaccaaccgcaccaataaagtgggtattagcaccagaacgttgcgctgcgacggcctggttcgcgcccttaccaccaccggctgaaaagatttccttagtgtgaatcgtttcgccaggctttggcatgttttcaacccgaatcgtccggtctaagttgatactcccaataacggttaccgtattcataatggtccctccaaatagttaaattaatctgaatttagtttttattaaaacgttttatgaaaacgttttaataactcgtaaaaaatataacacatctgaataattaattcaaatgtgccgtcgaatttctttcaattaatttaactggtaagtggtgttcttcccatggctgctgcggattagcaatacggtcgagtaactggttggctgtcgtttgccccaactcaaaaatcggttgtgcgatggttgtaagctgtggcgcgacatattggcacatttcgacatcgtcatagccaatgacactgtaatcatccggtatccgcttatcatgttcagccatgcctaagtatacaccgaatgcgatttcgtcattgactgcaaagatccccgtaaccccagtcgccaaaatttccggaacaacttggcgaccacccactttagaaagcggcgtcgcgatgacatgtaccgctgtccgcggatacacactataaaaaccactaagccgcttttggacattggctgacggttttgctggaataagaacggcgacttgccggtgtcccaaatcttttaagtgttgagcagcttgccgccccccatcatagtcatcagtcaacacagaatcactgaacccttcggcgcgcttttggtctaagacgataaatgggtgacccttttgccgtagaatatcattaatcgcattattggaaacggccgaacttgcgataataaagccatccacaccccggcggctgagttcatccaaatagacgcgttctttgtcttcatccagatcagcattacacaacatcgtgatgaaattttgctgatacaagacattttcaatgcctcgaagtagctcaccaaaaaagggattccggatatcaggcacaaggaccccaattgttttgctggtcttcttaatcatccgctgagcaaagtaatcgggctcataatttaattcatcccgggccgcttccaccttagcaaccgtcgccgcactaaacttatcaccatgcccgtttaaaatttgtgacacggtcgcaattgagcgttctgcaaggcgcgcaacatctttgattgtgactgccttatttttcatgggcttctcctccgtaaaattaactcttgcattattgtagcctagaacgccgaattttcctaaccgaatctcaaaaatgttaatagccatataagtatatggtagattgcaaatttannnnnnnnnnattttacaatctaccatatccataacgattcaaagattctaagccactcacgtccagcatcaaaagcgtccagattaaaactgcgtccaagaagcagccataccagttgcttcttggacgcataatatttttaacgtaatttccccttgttaccagcatagacacatctattacaaaccgtatagcgtatcccatataccaaagttaagcccagcttgcaaaaactagcgcgttcggaatcgaccgaaaatcacagcagatacatgaactgttcaatatttaaggcgtacccatataaataccttaatacgctccaaaacaaatttatttgccgtgtgtcgttttctgagcattatcctgataatcgttaaccctttcatcaacttcagcctcgtggacgataacttgtgaatgatcaccattcaatgctgcggtcgcttgttgaatagacttctgtaaatccgttaattctgtcgtcattatttttctcctttgcataccaagaaaatgggcggtctcttttaaccggccttcagccatccaggccctacctatctttcaaaaaagttgctttataatacggtcatatctgactgctaaaagcctaatccgtctttgaaacaaccattcaacaacgacttaattctacttcgttccaaactagattcacaaatcaaatataccctattttcaattaagttgccctgtcccacattatccaacatttaataagctcgtatcgtcacattcatcagactggcagcgcttaccaggctaaaaagtgtcacaatctcaacgtttcgtcacctgagtcccgtgcgtttctaactccataatttctcttatatatttaaagggaaaagggacaaccgtatactggccgtcacgaacatatccactatccatcaatgttgatagtaacggcataattctttgaatatctgcctttggttgcatactatcaagggcaacaacttgtttcaaactagtggcgcgagttaaatcttgcttgatgatttgattccggccgacatagtaatagtagtccgatcctaacatcaacaacccaattccgtaaataccattccaccaatcatcataaatctgttgcttgacaggcaagtgtaaccacacatgcgcattatcgaaaaagcgttgattaaaggtagccattaactttggacgccaactaagtgtcggtgccgtttttagtatcttttgaaagctcccaatagttattgtctcggtattgatccgttcaatcttcgtgattaatgcttgcttcaactctcgattacaatcatctaattcattagctacttttaatagtgcccagcggtgaattgagtgatgtgacctagcttttctcatcattgcattaatttgttctgcattcggaataattcgtagtgctgtttctccaagcttatataatttatcctcatatgctaatattttggtgaatttaagcgtttcccgtccattttcctcatcgaattcgtgaatcactctttcaaactctgccgacagtccccgctgtcccttagtagccttctgagatgttaaatttccggcatcgtcgatttccaaacgataatatgccttgtcagccatcatataatatcggaatttggcggcagcagccatctcatcacgatttggaaacgtgatttttccactcaaaatatcctgtttaatcaatagctgactgagtaacgtccgtatttttgcgtcttctaacaaatgtactttgtttcctaaatataaggcgttacctgccaccttctcgttaacaaagtttttatagattaaatgttggatcacctgatgtggcgtattcttttggtaccgcgaatcctgactatcatctagaatttggatattgagcccggtagtcatcgcactgtcagttataattttaatctgacaggttgctaattctggcgtgcgctgccatagtctgccaaatgattctgcgaactcccgttgtgctgctgattcaggatcaatcattagcgtcactgttttatggataagttggtcaataattcgtgcccgcttcagaggcgtaacgttctttttatcgacagccatttcagttaggcaactgtgtgcaatcggccccgatttgaaacacatccaatactgcaattgcgtcagacttaacaatttatgcaacgtactgaccttgtcttgttcataatcactttcctgaattgagaaaaagttaatgagatttttttggttatcgacacttttaagtctaaaaatttgctgtcggttccggtattgccatttcatacaaccttcgctcactgcatagccaacattgaccgtatcatcctcaatctccgtaaatattcgacttattaattttaggacatgttgatcaatcataacctctaaggccacccgttgctgtggcttttcttttgtgtgattaggcatgattaagaagagtctatccgttgcgttaaagttacaccagtctcggttttcgtccagcttaccttgaaaatgacatttcattaacataagtaataaatcgtcatcggtgataccatactgccctaactgttcaaaattaacaaacttttgctgaatatcagggtccgtagccatgattttagccgtgcgactaatcatcatcagataccgcgtttgtctgacgttgccattgatcattactgtaagcttcttaattgcgagtgcttgtgctttcttaaaccaactacctaacttttttggaatttgtgttgtaattatcgcaaatctaaattgttgattaatacccggatcattaaactcaaaatcaatgtagttggttttggctagtttctcttcagtattcatgaataaatgtcgccaccttctgcttttcagtttcggttaacacaaattggccttggcgattgagtaaagcaggaagctccatcactcgttgtccttttaataaatgactagtaaaggtgaggtcactatcgggttctatcagattgacaatcaacactttccaatcatctctaccagtcatcttgcatactcgtgccagttttttcaacacccaatcttgttcatcatcgttctcactattatgaggatagcgccagtttttaacatcaactagcacccgtttatcgagttgaaagtcaaacagttcattcagctgattccccagtagactagttcgatattgccactgatccttaattacaaactgcgcgctaacctcacccaaaatgccgcaatagttgtcaaattgtaccggattcaagatataattctttgattcccattcaattgcccattgattctgtttaaaatgcgccaacatccccggataagctaataggattggcagccctgccgcagctgcagagatactttctcggccattattgttttcggggaaatcaaacatctcaccatttcgttgcacatgataagcattcgcttgcatatcaagataagcaaattcaggttggtctgtccgctgattattcattagcgtcggatgttgcaagtaaaattcacgcgccttctggtatcgccgtgcaaccacagctttcacctgtaagtcgtgcttaacttgattaaagaattcctgactctggttagtatgattacgccaacgttctttttttacaacttcacttgtcaccactcgccagtgactttgccgctgatagtcttgcagcgcttgcgcaattggtcctaattggtaaggcgccatcgatgtcacgttataataatctaaaacgccatcccctataataacagtcacttcagcaactttattaaacgtgcgatcaagtcggccgatcgcttgtaggatacactgtgtttgtgcgccgacataacttaccgtgtttcgaaactgtttgattggtcgcccccgactccgttcacgcgcatatgttttgatatcatttaatgagatttcatccgcatcagctagttccatatactcataataaccacgaatccactgcttcgtattcgctttagtggcgcactcaggaatcagggtgagcaagtgcgttatcgctccaagatagatcccatcaatatcaatttgcttatatcgtggatcctgaatatcagcgtcctcaggggcaatattaataatctgcgcctgatctggttcagtattcgctcggaccagattaacccctacccccagggttttgtatgcgcttagcaaatacacacgcgtttgttcttcagaacgtacttttaaagctgcggccacttgttgttcaatcggttcactttgcagctttttggcaatcatatgaagttgcggtaaatgcttttcgtccggacagagaaggcctgcaagtagttcaaatacttgctcgattacctgaactgacattttaattgtatctacttctgtatctaactttggtagaacactttgtagccctgatacgacccgtcgatttcgatgacttagaaaacagataaagcttccaaataatgatagataccgcttttggcaataaagcgcattgtcgctaactttttgcttcagctgctgcattaactgctgtacaagttgttcgagtaatgctaattgagcgtgattatcatcattgatttcaaaatttgggtgatatttcaaaatcaatttttgcataacccggatatcatctaattgatcaggatcaggaataacatttatcacgttgacttgaacaccttgctcccggcaccgggaactaacatccatatcttccttggtggctgcaggaactaactccgttccttttataaacgcggcacccagttgttgctgaatatatttgaaatcaaaattgctaatgactgtttctaggtcggcagttgcagatagtcccagaacacgattactgcgagctaatttcagcaaaaattgttctggcgtcgtgtatatgaaggccgctccgatctccgttcgattaagatgcgcatcactatcagtcaacgaaaagagttgcatgccatggtcttgtaataatcgcccataatggccgttctgcaagttgtcgccaacatttccccggatgtttttcagagcttcgatttccagtaaaacaattttttgtgtctcgttagaaagcctcaaagtatcacaaatagtccggacagaatcagcaaattgataatagtcttcgacttcactacgccgttcattgatccgtgcttgatagcttgttgcccactgcgcaatttgtatcacaaaatacttaatgaatttattaacatcacggaccattccatagaaatttaaattgcctttggccggctcagtcgattgtaatgcgacatatttcccgtctggatcatcacgactccaccacgcactactactcgttatctgaaggtgacttaaattaaagataaaattagttgctgctggactcccctttgttttatagtcttttaacaatttgtaagctgttgctaattcattggttctactctttagattacgtaaccgatgatccttacgtaaaacagtcatgatatccgctggacggcgcttctgttgatcattaaccccggcgtaaacctggcaaaaaaacggctgaaaatcaattggaatcttcagggcatcatcaattattttattgagcaaaatcggttttaacccgtcaatttcgtcaaaaataacagttgcttgattcaatacggtagagctactaactgtaattgagtagccgccccaaaaggatatatatgaacgaataaacttatcagcaaccacaattatcaattggcggttagctaaatcaatggttggaagataacgattaatgtaggctgtcaagggcgtctctttgtcacggacatgccgtttaatagtctctttgtcactttcactgataggttctgcaataccgacttccttgataagctgttgtcgaatcgtgcgttgataattaatatacgcttgcttcaatccatggttattcggcaaatactgtgacttaacatcttcacccatatgcttaaattcatcataccgctgcgctaatgtctccaaagcctcttggatgtcccggtagtgttctaacgttttaggtaatttttgtgtcgttattatattgaccatggtcggtaatgaccgtaatactgcaaccttacgcgtatagaacatcataaaatctgactgactaactttcagttcacgcgttatccattcacgtttaatcgattcataaaaacgatccgcatgtaagcttttattctgattagccacaaagcaaaagcgctcatcagtataaacaattcgcctgctaatatgttgccgtaccgcaaatgtcttgccactcccagtaggaagcgccaaggtcatgagagcgcctgtccgatcaccggcctcagacacctggttcatagaagctaataatgttgcaatatctaatgacaatatagcgtcctccttaattccattaccgtaacaaacggttaggataccatcaacaggatttaccaaaaaaatacacaatatttaacataaatatacatttttagttttgtgtaaacttacgcttaatcgcccaatcaagtagtcataaaagaacaaaaaaagcccgcgctcatcatgagcgcgggctcccttaattcacaaagggctatttttcagtaccttggccgtcccattcacgttcaataatcgcctttaattcactgattaaaggttcgcgtgggttagcggtcgtgcattggtcttcataggccagttcggctaattcgtcgacggtggcgtcaaagtgcttcttttcgacccggttggctttcaaggataaggtcacatccattgagtgagccaagtcaatgtaagctttaactaagctttctttgagttcttcgtcggtcttgcctggtaaccctaaggcccgggcaatgttggcatagtcggctaaggcagtattatggttgtacttcggccacattgctaacttcgttgggatttcagcattgtaacgaacgacttgcggatacgtgatcgcaattgccaatccgtgtggtaagttgaattccccgcctaatttatgggcgatcgagtggttgatacccaagaaggcattggcaaaggccatcccagctagcgttgaggcattgtgcatcttctcacgagccatcttgtcaccatcataagaagctttcaagtacttgaaggctaattgcaaagcttgaattgaccagccgcgtgtgaagtcagaagccatcgttgaaacatatgcttcggttgcgtgggtaattacgtcgagaccagtccaagccgtcgtccgctttggcaccgtttcaacaaattgtgggtcaacgatcgcaatatctggttgcattgcgtagtccgtaatcgggtatttgacgtgcgtcttggagtccgtaataaccgcgtatggcgttacttcagaaccagtcccagaagtcgttggaatcccaatataagttactttttcagatactggtactttgtacgtccgcttccggatatccaggaacttctgtttagcacctaagaaggaagcttctgggtgttcatagaagagccacatccccttagcggcgtccattgcagaaccaccaccgagtgcaatgattgtatctggcttaaaggccttcatccgggcaacccctttgtagactgtgtcagtcgacgggttcggttcaacttctgagaagatgtcgatatcaaccggatcagtccgcttgttcaagaccgccgttactcgatcagcatagccaaattcaaccatcccaggatcacaaactaggaaaaccttcttaatcccggccatgtgttccaagtagcgaacggaattgcgttcgaagtagactttgggaggcattttgacccattgcatgttattacgccgttttgccacagttttgatattaatcagatccatatctgtaacgttatgagaaatcgagttgccaccatatgatcccgtgcccagagttaatgaaggcgccatgttattgtagatgttacctaacccaccaactgaagatggcgtgttaactaagatccggcaagctggcatttgtaagccaaattctttgaccaatgcatcatcggtcgtatgaatcccagcagtatggcctaagccaccatagtgaagtaattcattagcccgtttgaacgccgcttcatgcgaatccgctttgtaaacggtcagaactggtgataatttttcgccggataatgggtacttgataccgacaccattaatctccgcaatcaagacccggcagtccttagcgacatctttcaagccagccatttgtgcgatttgataagctgttttaccagcaactggaccacgaactgtgtgccggttaggatcaatgacagcatcactcaaggcttgcacatctttaggtttaacgtagtagcaacccaaacgaataaattcagctttaacttcagcataaatttccttgtcgataatggcactattttcagaagcacaaatcatcccattatcaaacgtcttcgataaaacaatgtcgttaaccgcctgcttaatgtcagctgttttttcaacataagttgggccgttaccaggaccaacacccagtgctggtttacctgatgagtaagcggctgtcaccatacttggaccaccggtagccaagatcgtcgcaacatccgtatggtgcatcaaggcgtcggttgcttcaatgcttgggtgttcgatgtataaaacagcatcagctggaccaccagcagctttaatcgcttcccgcatcacatcagcagccgcagaactacatttctgagcttgaggatggaaaccaaagacgatcgtgttacgcccctttaatgagatcaacgtcttgaaaaccgttgttgaagttggattcgttacgggtgtaaccccggctacgataccaactggttcagcaatttccattagttgctcttcatcgtcttctttaatgacgccgactgtcttatcatggcgcatgctgttccagatatattcgctggcgtagatgttcttaatcgccttatcttcaacaacaccccgaccggtttcctcaaccgccaacttggctaacttcatatgattgtccagtgcggcaaccgcaaccttttcacataaatcatcgatttgtgcttgggtatatgacttcaaaatagctaatgctttcttagaacgttgaactaattgatcaacttcgtcagtaactttgcttgtttgatttttttctgtcttaatcatgaagtgcttcctccgttcaattcctttgtgaattattttacaaactttattatagccatccttgctcataatgcaacaagaatttgaaaaattatttaatatcatccaaacagtacacttataaactcatgtttagcagtatttatagccaataaaaaaattcaattgttaagttcattaatgaacaatagcagtcaaaaacaaccgcaagctcctcattagccatgatgagcttgcggttgttaaaatttcatcagcttggatcttaatccctgtcccgagtcttgattaccgaacaacgataactgaaataggtgcttttcgggctaaacgcggaccaattgccccagcaatcttagaatgtggaaattcagtatcggcaccggtcactaatagatctggtttaaattctggaataacttgctctaaaatgacgtcatccacatcaccgccttcatagacaagcggctctacttgattaacgcctcgttgttcagcaagctgaacatactcggcaacaacatcttcaacgtgtttccgtttagcttggatcttcgacggtgttaatgaatcaaagatattgatatcttcgctttccagcaccgaacaaattcccaacggaacatcatagtcgtgggccaaagtcgttgcgtatcgaaacgcacgttctgaagaggtattatcgtcctcatcaacggtcagtaaaattcgccgatagacaagtggctcttgcattttttgattttccatagttaatctcctcattgaagtgaattgatattgaccactgccattataccagtttcagaattcaaacggcaccatttctcacacgcatataatcataagctgatttccttcaaacgccgctctaaataattaagggtagcttttaacgctatgattccagccaccagttagagcggcagcactctccccattactccggtaaggctttcaacgtctgcttcaaccaattcacatagtagtcttctcgtccgatcgcatgttgtaagatcaaatagtgaccataatgttgcttagcagctttagcttgcgggaaaacggtcgccaatcgctgttgtaagtgtgctaacttagctgtgtgcagggtgagctgttcctgtaacatcgctagtaggcgtggatcacgatccgtttgaataaagtatagttttaaaataaattcatctttcgtagcggttaagtctggtgtaccgacactgatccactcatgtaacagctgccgaccagttgcggtgatatggtagagtttcttttcaagtttttcgccactgaccgtaatttcatgcgtgacgtaaccttgttcttctagtcgcttcaattgcggataaatttgactatgttgagcttgccagaattcaccgatctcgtcatcaaaggctttagttagatcatagcccgttaatggttgctggtttaataaccctagaataataaattgtaacttgtttttttgcgccattggaaattcctccttgacgattccttgataacagtatacactaaccttgttgtttaaaacatgtaataaattacatgattaaaatgacatattagacataaggaaggtaattctaatgacaaaaacttttaaaatacttgatgactttctcggcacacactttatctacacttatgataacggctgggaatacgagtggtacgccaagaacgaccacaccgttgattaccgaatccacggtgggatggttgccggtcgttgggtcactgatcaaaaagctgacatggtagattgtaaaattaatnnnnnnnnnnttaaatttgcaatctaccacatcgtcatgttgaccgaaggcatttacaaaatttcttggactgaaccaactgggactgacgttgcactagacttcatgcccaatgagaagaaactacacggtacgattttcttcccaaagtgggttgaagaacaccctgaaattacggtcacttaccaaaacgaacacatcgatttaatggaacagtctcgtgaaaagtatgccacttatccaaaactagttgtacccgaatttgccaatattacttacatggacgacgccggccaaaacaatgaagatgtaatcaatgaagcaccttacaaagaaatgccgaatgatattcgcagcggcaagtactttgatcaaaactaccatcgtttaaataagtaatgtttcacgtgaaacattctggtctacaaattggataattagcagtctgtccaatctttgaaaattactaatcatctgaaaaacattcatttagcaacacttcaaaaagaccttcataaatgtcatgacatttatgaaggcctttttcgtaattattttacttaggcttccgttacatccagtgcgacctgtcccagcccggcatcgaagtcggcttgccagtgccccgcggtcaaatgtggtggtaggacaaacgtccccgacgaaactcgttgaccagccgttaatgtcttaccttgctctgcaagcttgccgactaaccacttcaatgactcaagcgggttacccaacacttcactcgcttgaccagttttaaccgtctccccatcatggactagcgtacactttggcgttgctactgcatcagctgaagcgaacaactcggcagtctcccgttcagttccatataccactagcccaccgactgcggcatccgcgaccaccaaatttttaggcaaatcgggaaaccagtcagcaaaacgtgaatctggcaattcaagtcccggcgcgacagtcgttttttgccataaatcggtcaatgaatcggtggttgacagggcttctttagccttaaagaccaactcaacttcgacgagtgggtccattagttgcccgcgtcgaaccgtggttggtgccgccaaaaagtgatctgcaacctgggcaccgtacagcggcgtatgagcatcaaacatcttttgagtttccgcactcgtcaacgagaccttgtatccgccaaccggctgctgttttaaggccgttaacgcggcttgaactcgatacgcagcgtcttcgtcagcgacactacttgtaaaatcagccattgttaacgcatgctgtgtctgataggccgtaaatagctgttgtgcaacttgagtttctgtttctgtggtggtagttgtcattataaaacctccattatgtgtttgtggttactgttatcctaatatgtgttcgtaatgaggccgtctaatcattgctaatacgttaactcattacaattaatctagttgtcacttcattatttggatgtattcattcagtgcgctaacttaatcgtacgggcgtcttaaatacgaattattaagactacgggtcataaatatcgttcatgttaaaactatgtgtgcctaaacgtataaattgcacgttgctaaaactatgtgttaatcgatacacgtggtatcgtatgtgatctacccggagtactcagttatactatgtgtttttgattccttgttgacctatgtgttactcgaggagcaagtcctcgtgcgactagttaccattgcccacatttgttggtaactagccacctgaatgtccgattccatactcctcaccacctttaaatcataaaaaaacgtcctttaactaactcctatgagttaattaaaggacgtccagaacgggttaccacctttattcgcgactacttcacaatagtcaccttagtacgtacagcaattgcgatacgccggtacattaatgggtaccatccagcaccatctccacgaatttcgaggcgcaactccaaggtgatctatgttaagtggtattgactgccttacaccaatccgcagctcgctaactaaccagcttagcaccgttccttatcacggcttttaatctaaatttaattaatgattagattctagcgccagattatcacaatgtcaaccttaaaattaaaaataaattagattaattaagtttgcgctcattggccataacatccactaatgccacgtactgctcagtatgcgtatcacgcaacgtataatttggtgggagcgcgtccgcatctgctttgacaattcgaaaccctacttgcgcataaaatcgcagggcattttcgttggccatcacacacttcaacgtgagtggttcggttgcatactggcgcatttctgtcagtagccgttcaccaactttcaagtggcggaaatctggggccacaaaaagcagatgaatgaagttggccagccggtacaacgaacaaaagccagcccgctgaccatcaatccacgcgaccagcacgaattcaccacggctgtcttcgttaaaatcttgcagttgtggatcagtgacccatggaaaatcttgctgacggtccactaaatatatttcagccagcgctgcttgatccgcagctgttgccggttttatctcaattcgtttggtcatcctgcgccctcccccatttaatgattctcattatgacgttagttgttgagaatttcaaacattaatcgccttaatctattcatcaaagctagctttcaactactgacaagcgttataatgttaggcaatactttcaccaaatgaaagcgggggaaaaatgaaaaccgcaattgtaacggatagcgcaagctacctctcagcggccgatgttgaaaagtatcatattcacgtcgtcccaattactgttatttttggtcaccaaacctacttagaaaacgtcgaaataacgtccaaagaattttatgaacgaatgcgtaccgcgcctgagttaccaacgaccactcagattacccttggtcagatgcaaacgacttatgatcagctggcaaaggcgggctatgatgctgtcattagtatccatctttcttctggtatcaccagctttattactaatctcgaaagttacctgccaaacgtaaccaacatcaaggtttatctgtttgattcactaattacggctggtggagaagcttacatggtcttgttagctgctaaattagtcactgaaggatactcacccgaacaagttattgctcagctcaaaaaaatccgtgaaacaaccggcgtatattttgttgtcgataatctcagtcacttggttcggactggtcggctctcaaacgcttctggactcgttggcaacctcttacgcattaaacccgttctgacctttcaagatggcaagatcgtcgctattcaaaaagaacgaacgatgcggcgggcatacgcagccatcaaagccaagctggctgccgagattgctgccgttgactattcacttcgcgtcacaatcgaaaacggcaacaatccgaaactccaagccgaatggacagctgacttgaaggctagctttcctgatctcaccatcgatgaaggcgagatcggtcccgtcgttggggttcacgttggagaaggcgtcatgggactgatttgggcgcgtgactgggaaaaatggaccatttagttcaccattatcaacccctgataattcatcatgacagtcaaaaacaacttttgttcctcacgacgagctgaggagcaaaagttgttttttgcattgccttatttccgtttcttgccttttttctttttcttgttctttttccgctttgtgttgggctgttcggccgacttagtcaacaacttccgtgcctttttgatcaacttagatcgttgtttggtatccagctgttcccacaatgttattaattcggggtcaacggcaggggttggcgtgaccgacactggaatcggtaccgcttccggggccaccgctgttgcaacatcagtcgtacctagcagccaatctggcgacacattcagtaccgccgctaacgccgtaaccttatcatgtttagccacgtatttattacttaaccactggctgattgatgaacgaccaattcccgtttgtttagataactgagcagaggttatgttcgcttgttgcatcgcttcttttaatcgttctgaaaatattcccatcacattaccctcctagtgcaacggatcccatgcgggtagccgctgtgcacgttcgttaagcagcgcctgaaattccggtgccaagaaatgcttgtgaacaactacttcatagacgtactcattaaaccaatcttggctcattacgaagtagccttgatcacctacttgctcaccccaactattttcgaccttccacttagttggcgtatcagccactaagtcaacgccggttaacgtcatggcatggctaacttcaccttcacctgttaacagccgttgcgccttagtcagatgatcgttggttccaaataacttgccagtttcaaataaatgagcatccaagtatcccgtcttccggtccatctgtcgcaacacatcgttgccaaaccaaaccgtttcgccagcctgtaactgttgcacagcaacgtccgtcagcacacccatatcaaggttcaaaaattcgataggcttaccaccaatcacgttatcctcgtctggcaagctataaagtcgattaaacggcttatctggtgaattagtaacgaccacgtaatcatccagatcagtttcaaagtagtcctgatagaattgctgaggcgttaaattagccgtacgatggtactgttgctcatcatcacgatattctaaatcaaagctagttggtggttcaccaaatgagtacgccgtcatccgatagaccgtttgcaacattgatttctccagtgattgtagctcggcctcgcttgcaccatccatcacgagttgccgaagttttaacccatctttacgaagctgccgtgataaactggcttgaaatgccgtcgtattatcagtgttgaaggactctggcatcacactagctggaacgacgccatacttttgaaccaagctggccgccatcgcccactgaccaccatcttcgcccggattagcaaataagaactgaacaagccggtcatcaatcggctgacgcgccgtttgttcaacattccgataaaaaatattagccctttcaatcttatcccagaaaaacaaatagttttgtgataactcaaagtctttgacgtgataccgggtcgcaaacttatgccggagcgtgtttaataatgaaaactcccagcaacgaccgctgtgcttctgattactgaccttacccgttggtacttcaacagaaaaagtccgcgctaagcgactcgcagcttgattatcaaaacttgcagcctcaatcccattcttcgtaatcgctcgcgtcaatactggtgccattcgatcctgcgcatgcgttgtccgtaaagcggcaagtgcatccggtgttagttcagttgccatatttaccagcctccatcgtgatacttgccattattctaggcttattgaccattaaattcaatttagatgctaccttttgtttgcttttctgaacaagattagtcactttaaccatcccacattgttctccctgtaaagaatgactaagtaacctagtttccccccctaccattcagttggtgagcatacaaaaaaaagcgcgctcactaacgagtcgcgctggctgctattcagtaactaattgaattaatattatggcgcttagtcttattcgagtcccaaaatggcactttgaccacgcccaacaccttattggctgggacaaatccccagtaacgactatcatttgacactgaccgatgatcacctaacacaaagtacgaatgcttagggaccttagttgttttcagattccaactgtaacggttctccagcgtactcaaatcccaatttgtcgttccctgcgtccgctcatactgactgatgaacttctgcgggacaagcttgccattgacatagagtcggccgtcttcagatttaactgtatcaccgggcattccgatcactcgtttgacatatttgaccgtcttggagcgtgcgtctggatcaacttgataggcgttaaaaacgatgacactgaggtgctgaatcttagctgtcttgaccacggcgacgcgctcattgtcatctaagttaggttccattgacggtccatccacccgaaccatcgtaaaaataaagtgcctgatcaccatggcgacgagtaaccccactacaattggtagtacccagctcataatactcttaaaagttttcatcaaacgttctcccttaccccgctataacttccaatcattatagtccaatcaactcagcttgtctggtattggtgaatcgtttttacaaatttataagtaaccttgcaacgatatcacactaaaatgaccaccaaaacaatcttgacggtcattcataatttccttaatgactaactaacacatcttgatgacatctttcttccactcatcaagattgtggtgtatcttgcaaactccaattgatctttccatgataggatcctgcatacaattcgggctgaacatcgagaaaaataccttgtcgcgcttgccaggttgctgcaatattagtagtttgttgattaggatttgtatgtgtgccatggcctaccaacgtttcctgattggtcatcacatgtttttgaccagcagcatcaatatagaccaaatccccaattaatgagtgttgagcagacttcattttagttgcggtggcatacacataccactttgaagcaactgatcgcgtatcatgaacctcaatttgccactgatttgtgggcgataataagcgctcgctttgtggaatcgtgttactccgaaaacgcatttgagcattgatttgaccaaacatgagtcctgaatttacattaactgttaacgtatcaatattagatcgttggccgtgttgatctgacacccacactttcacatcattaggcccttgtttaagcgattcagtgggtaatttcagatgaaaataccccgccttatctggctcattcaccgaaccattagccttataattagcgatgggcgttccatcagcatgggcaaagtggatggttagtgcgttattttttaaaacaacatcgcgatcaaaatcattctgatcagtccccaagatcattccggtcactaataccttgcgtcccttagcggttgaaaaggtatgaccattagttaaaaacaagttgagcttaatcgtcgcatccgttcgtggagttccgttattaatcaccgtttcagtgtgccctggaatatcatcatacgcatttgtttccgttaccatcaagcgaccattaccgctaaagcatttcatctgccagcgcccctcatgatcgactcgtgtttttttgatctgattaccaaatttagccgtgattagatcaccaccttgtgtgcccgtcccggtaatgatgcgcttattagcctcaaatccagtaatatgtggtgataatttaatctgactaaccatttgacagtactgcttcgttaccatgtaagcaggcagtgttcgaatgggattactgctcgcattagtactgctcttattaccaatccaaaccggctgacctgctttgattccatgcgtcttgatagtatctgttcgatgcggtcgccaaactcgattattgatattataagccaggaaagttgcaccatactctttgccttggcgattcaaaaccagatcccataaattatataatcccttaccattcggcgaatgtactacacctttacctaaagtaattttcactcgactagtcttgtgcgtcatgtgaccatctcgcacataattagccgcaatgtgtgtaatgggccatggcactcgaccaattgttcgttgttcgaaattagttgtaatatcctgcatcgcactggtcggctcatcgacaacctttgcctgcccattaacagccatgaggcaaactaccaataacagcccacccacgaccaacgtgccagtaagtaaccttctcacttctacggtccctccttacctagcaatagctttctttattaaaccaacggataaccatcaataatatcagtagcacgctaccgaaactcgcataaaaccaggttaagagctgctcatcagtctgtggcaattgataatacccctttggtcttgtcaacgtcttttctgtcaccacacgatatggcctggtcccattaggaatcttaacgttgcgattatctatctgttgctgagttctctgaccagcataaaagctaacggtgactgttgaccgccccccaacggccgcaactcccgttattgttaacattattaaactgattaaaatggttgctacacacacgctaaaccgttgcaccatcctacccccattaattaacctaatccttcgaccgccgttgtcgccgccatagccagacgattacgcctaaccctaaccccagtactagcattgaaattgcgccaattccaattagcatccacatactaacccccttattatcaattgactcatgattatatttttgagctgctgtcatactaatatgaaaatctcgtttaaatcgccaatgatgacgctgattattaaccgtcatttgtaactgataatcacccggttgtaattgttgtgatcctaatggcattggtgctttaaaaactgtgtttggcgccatcatgacacccgttttcgtattcttaataatgaccttttgatgccgcttattaataatcactgttcggatttttaaattcggaatgattcttgcgacaggattacgtagcgcaacaataatgcttcgatgataattattcaagccagctttcaccggccctagacacaaattaggaattggcaattttcctgaagataatttcaacccaataacatacgaatactcattcttaacgttgatacttttctccgttactcctgttaccttgtcatcaacccgtttaaaataccatccacccaacaagacgccatttactggctgcttaggtaacttcaccttgattgcgaccgttttggagccttcagccggaatcgttattgtccgctcaccctgaattgtggctaaatcactgactcggtattttaacgactgatcgtacgatttggccggattaatatattcaatcgtcccattagtattcgtatacgcggtatgaatagccgttcgaaccttaatatccttattagtgacattgtaaatgtctgtccgtaacgtctgctgttgaccgattgccattttcaaatcaaaaaaagaattttgtttatgaatctgattttttggtatctcagcggcaacactaaaaccgacattgttgttgtggaccgattgttgccgattagccgacactcctgtctgtccgattaaaatactaaatccaagactcacacccattagtcttatgaattggataaccactttcaatctcaacacaccccatattatgacgcatcttttaaaactatcatttaataaaagggaagccactgctcgcgattacatcaacgattactttatccataataaccgttagccatcgccatctgctttagcttcccctcttggttatattctaactaacttgctggtgtatcactcaaactccagttcaaagttgtttggtacccctgcgctttagccgtgtttgccggcaccgttaacttaacattacttggatcaatttgatcaacagttacaccagcatcatgatctttcgctgccgataatactgtcgccgaattaccatctaacacgttaagagcctcagtggactgcacgccattattagttgcaccagaattagttaccgtaccttttggtagctgaagcgttgcccctttcattacagaaccgtctgtaccagtcaaactactcccggcaacggccagtgtccaaccagcattacttcctcggacatcagatacttctgtgactgcttttttgttccataaacctgataaatccgaatcagtttctgcggcagtgtacgtttctggatttaaaacatcgatctcatggcttccaaaatctaatttattagaaacgtagatcagcgataagccgccaccggctttagcaccgttaccactatcaccgctattatcaggcttattgggattatccggattaactggtgataccggactactattacctttaaacatcgcctgaatatcagtcgtaccagtcgtattggccgtactatctgcgttgggagcagcgggcgtatctgcctgagcgatgacacccgaactcactaataaactacttgccactaaaataccactgactaacttactaactcttaccaacaataactccccctttattttgtaaacactgtaaacaatgtttactagttctgaagtataataccttaatttaatttagtcatcattaattaaagtgttgttgtttttttaatgaaacgtgtactaattaaaaagtaagctcactaaaaaagcacaattccaagttggaattgtgctttatcgttaaaaatattaattttttctttcatcattcgttaatatcaactgaacacaccagtcataacctactactgatgattattgaactttagcgattcgcccctgttgaatataaacactcagaattgcaatatccgcgggattaactccactgatccgtgaagcttgtgcaatcgttgtcggctgaatcttctttagcttctgatgagcctcagtcgctaatccgtcgatcgcatcataatcgatccgatccggaatctttttagcttccatctttttcaaccgatcaacacgttcctctgctttttgaatataaccggcatacttgatctgaatttcaacttgctcaataatatgccgttctagtggttcgggtgctgccgggataaatttcattaaatcagcatattgtacttctggccgctttaagaaatctgccgccaacacaccatccttaagctcaccagaattatgagcacgtaagaaagcattgacctcatcattaggcttgattctgattttgcctaaacggtcaagttcattcttaattgcttggcgtttcgcctcaaatgccgcataccgttcatcatcaatcaatcctaactcgcggcccttatccgttaaccgcaaatcagcattatcatgccgtaagatcaaccggtattcagcccgactcgttagtaaccgatagggttcattggtgcccttagtaactaagtcatcaatcatgactccaatataagcatcactacgcttcaaagtgaattggccacgatcaagggcacgcaaaccagcgttgataccggcaattaatccttgcccagcggcttcttcatacccagaagtcccattcgtttgaccagcagtatagagattcttgaccaactttgtttccaaggttgcctttaactggtaaggcgccaccacgtcgtattcgatggcataacctgggcgcatcatttcagcgtcttcaagacccttaatggaatgtaaaatccgctgttgaacttcttccggcatcgacgttgaaaggccctgaacataccattcatccgtattacggccttctggttccaagaataattggtgccgcttcttatcagcgaatcgcacgatcttatcttcgatcgatgggcagtaccgtggtccgaccccttcaatcacgcctgtaaacattggtgctcgatcaagattttcacgaatgatcttatgagtcgtctcattcgtataagttaaccagcaagataattgatgctttagatcaatgtagtcagcatccttcgtttcaaaactaaaatgatgtggttcaggatcaccaggttgttcttccgtaacactgtagtcgatcgtattaccatcgactcgtggtggtgtaccggtcttaaaccgttccaagttaaatccaagtcgttccagatcaccagataacttcatcgctggttgcgaattatttggacccgaagaatacattagttcaccaatgataatcttgccacgagccgccgtcccagtcgtcaaaacgacactcttggcactatagcgcgctcccgtattcgtgataacgcccttgcagaccccatcttcaacaattaagccatcgacaattccttgccgtaacgtcagattaggttcccgttcaatcgtgtgtttcatttccgcatggtaagcatgcttatcagcttgagcccgtaaagctcgaacagctgggcctttacccgtattaagcatccgcatctgaacgtaagtcttatcaatgttacggcccatttcaccgcccaaagcatcaatctcacggacgacaattcctttagccggaccaccaaccgatggattacatggcataaaggccaccatgtctaggttgatcgtcattaagagtgtccggttacccattcgggcagcggccaatgctgcttcagaaccggcatgaccagcaccaacgacgataacatcatagtcgcggcctgggtactgctttacttctgtcattccaatttcctcctaccactacttacccagacagaactgactaaatagctggtctaataattcatcttcatagctatccccggtaatttgaccgagaaattcccagcaacgggtcatatcgatttgaaccaaatcaactggcataccagccgcaagtcccgtttgaacatcttgcaacgcttgtttggcttgattcaacaaaccgatgtgacgcgcattggtcaccatcacgttattttgactactttcgataccttcattgaagaacatcttggcaatccgttgttcaagttgcgtgacgccactttgttccaagactgacatacttaaaacgtcactcaaatcgactagttgcgccaattcagcttgatcaagacgggctggtagatcagtcttattcaagataacgattcgttttgactggtcagtctcttgcaacaactctcggtcttcagccgtcaacggttggctattatccaacactaataagactaaatcggcggccccgattgctttgcgacttcgctcgaccccaatcttttcgaccttatcttcagtgtcccgaattcctgccgtatcgacgagtttcaatggcactccacgaacattgacgtattcttcgatcacatcgcgggtcgtcccggcaacatccgtcacaatagctttgtcttcatgcaaaaggtggttaagcagactagatttaccgacattgggacgcccaatgatcgccgttgccaaaccttcgcgtaagaccttaccttgcttagccgtcgctaacagttgattaatgctttgggcgacctcggtagccttctccttcagcatcttggtggtcattgtttcaaccgcgtcatactctggataatcaatattgacctctacttgggctaacacgtccaaaatatcttgccgtaaatgtcgaatcagcttagatagatcaccatctaattggtttaacgcgaccttcatggacttatccgtcttagcacgaatcagatccataactgcttccgcctgtgacaagtccagccgaccattcaagaatgcccgcttggtaaattcaccgggttccgccattcgcgcaccgtgactcaagatcaattgtaaaatttcattagttgccacgagtcccccgtgacagttgatttcaaccacgtcttcacgcgtataggttttaggcgcgcgcattacggtcgccatgacttcgtcgacttcctgatgggtatcaggatcaacaatatgtccatagttgattgtgtgtgattgcactcgactgagatctttacccttaaaaatctgggtcaccacgttaaacgtttggtccccactaatccgaataattgaaataccaccctcaccaggcggcgttgaaattgccgcgatcgtgtcaaattctgtggtcgttggcataccatcatgtcctttcttgtcagcgtttcatcgcctaataccataccaaatttacttacaattagttaataatatgtcctaaaatgcagaaaaaaagcgcctagtccacgccaccttaaagcgtggataaagcactttgactactttatctaaaagataagaatgattaacacctactataatagctcacccggagtttgtcaaacgcctgtttgcgttactttgaataaactatttgcgaatcgccacaaccacggcccggtgcggatcgcggccttctgagaatgtggttacatggtgattattcgctagttcagcgtgaattaatttccgttcaaacgatggcatcgggtccaagaaaacttgtttgcccgttgcaatcacttctcgagccgtactctcggctaaccgcttaagtgtcgcagcccggcgctcccgataatcatccacatctagcaccacgttaacgtgtgacgcgccatgatgattcatataaacttgcgccaaatcttgcagtgcattgatcgttcgaccgtgtttgccaatcagcaaaccctgcttagttgtatcgaaattcaatgtcgcatagcggttgccgaagtcgacgtcaagatccgccgtgacacctagttctttgaccaccgcaagcaagtaatcgcacaacgcccgcaccgcggtctcgttagctgcttggcgcgctgcaatttcagcgggtgtccgcggcgtctgactctggtcagcagtcgctgatttggtcttactagtggtcactggtttagattggtcggtaccagcgataaccgggccggtggtaaccgccattgaagcgggtttagctactgcttccgccttgctagtcgctggttttgtggcactggtcgtggcctgactagttttagcttgtctggtcggcgttgactttggtgtccgcacggtaggccgcggcatggtcggtgctgtcgttgattcagtagctactgactgttgcgctgtcgccgtagcggaagttggcgtcgttgcaggtgctgcggaggctggcaccaccgttagccgtacttgggcggggtgtttgcctagccccagaaatcctttttttgcttcagcgatcacttcaacttcaacttgatcgcgtgttcggtgcagttgttttagaccagccgcgattgcagccgcgacggtattaccttcaaatactgtcatgcttgaatcctcctcgttaaaaatcctgctttcattatagcattaccattcgccatgcgaacacctgagtatgaacacttaatgaacccttacaacgattaggacttcggccgttctactactcctgaaaactcagactagcaaaatctagtgcttattatgtcaataaccaacctgttcatggcgcgtttcagagacgcggcccacagcctccctttgccgtatttactaattgccactcgcgagccgtatcaaagctgctctaaactcaataaaaccgattttcccgtccgtaatgactagaaaatcggtttataatgctagtatttttagccgactaattcacggcatctgacctactgattggccactaaatcaaaccactatcaaattcaagccagaaccagctcacctgtcagtacactaactggtcatatgacgaatcaagactacccacacttagccctgattctcaataagacggactacccgacctgccgtacaggaacttgctcatcaacaccggccgttttagccgcttgatgaacttgaatgccatgttggaaaacatccttatcttgctgaataacccgaatatcttcgattggattggcggtcattgcaataaaatctgcaaatttaccagcagaaatcgtcccgtattcatccgcaacatgcatcgcacgggcacagttgattgtggccgtatcgatggcttgtgcgggagtcatgcccgccttatcgacatagagctgcatttcgtatgctgattcatcctcaaagccattataaggcgttccagcatccgtccccatcgcgatgggaatgccagccgccgcggctttagtgatacttgcaaaatgcttcttgatgttgacgattaccttttcacgcgcccatgctggaacggtcttctcgccatatttataaatagcatacatcgcgttcatcgttggtacgatcacagtgccatgttgccgcatcatctcaattgtttcatcatcaatatcaaaggcgtgttcgacagtatcgacgccggcttgaaccgcctcttttaccccggcattcccctgcgcgtgagccgccaccgtcttgcctttatgatgggcctcagcaacggctgcttgaacttcttcaaaattaaactgaatatcatctggggtctcgccgtttcgaagtaccccaccggtaaccatcatcttgatattatcgacgcccattttaagggcctggcgaacaccttgaacgaccgcatccacaccatcgacttcttggccgccatccgcaccatgaccacccgtaattgaaaaggcctggccagatgtcatcacgcgagggcccgcaatctttccttctcgttgcatctttgaaatcgcaacgtcaatatcatactgggcgccaacattgcgaatataggttaccccatggtttaccatatcttgcatattgtgaatcgcatacatggtattatactcacgtgactccggatggcggtcttcctggccgtcatgccaccagtaagttggaatactggtaatatgtgtatgggcattcatgatgcccggcataacatactttccttgcatgtctgtcgtttgttcagcaatcgtatccggggttcctgtaccgaccgcgatgatttttccggttgcgtcgtcaacagtcatgaattgattatcgataaaagtttgcttttctgaactgtagattgaggcattgatatagttggttttggtcataataatgacttcctttcattttggcaggtcgcacaccgttcattaacggtaacggaccatcattttcatcactgcattgttggttctctaactgactattcaccacgcctcaccacctttcatgacaagtttttatttccaataagcatattgaagttgactggacgttccagaaaattcatcccattgtaagccaccaacatccttgctgaccaaaaatgcagaagaggcttggtaagtgggaatcacggcatcgagtttcatcaaccggcgatcagcttgcttttcataagtccaccgttgcgcggccgtgtatttcgccgtattagataccttggccatcaacgcatcgtacttcgcatctttccactgagtaaagttgatgctattcgagctctgcatcccatccaaaaagttttgggcatccggataatccggcccccaaccgactgtgacgaggtcaaagttccccgtaaaatcacgtgatacgtgggtcgcgtgtggaaccgcaacgatcttgatcgtcacgcctttcaaatacttttcggccacgccctggacgtattcagcgagtttcttctcagtatccgtatcgtcgcatagaaaattcaaagtcacattttgcttgccgagttccttttgggccttctgccaatactgcttagcttgcttgatattagtcggtgataagttcccaacttccttaacaaaatcctcaccagtagtcggatcactcgcgtagtttttcggaacaatgttcgtcgcggcttgcgagccgtcttgcaagacatcttttgctagtgttttttgattaatgaccaggcttagcgcgtgccggaaattctcattggcagttacggacttcttactattgaaataaatgtaattattccggccagttttagtgaccgtcatttgactattattggcattattcttcacgtactgccccgaaatgttggtcacttggaccgttccggcgttgaagaggttctgcgccgtattatcatccttagtgaccgtgactttgatgcgcttgatcttaacgttcttggcattccagtagtacttattcttaacgtaataccaactatcattagagcctttccagcccttaataacgtaggcaccgtttgctaccgtcgtcgctgagttactccctaacttaaacccgtatttctggactgccgccgtattgagtgggtaaaagctcgtaaactcataattcatataaggcaccggcttgctcaacttgatggaaaacgttcgcttattaatagccgtcacacctaatttattaacggccatttttcctttattaacggcatcaaagttcttgatgtaactaatggcatccaagttttgagacttcgttgttggattagcttgccgccgcaacgccgtcacgaaatcttgtgaagtgatcttggttccattttgccagcgtgcatttttgcgaatcgtaaacgtataccgggtcttgttttcagtaggcttgaccttcttctcgactacccccgcaacaatcttattattcgcgtttttgcggtaaatcccttcaccagtctgtgtaattacggcaccgccgttggtttcgatcgaagtcgttggatcagtcgtcatcggttcgccaggaatcgtgatgcctaacgtcctattttgatcagccgtactggtcgttttcgaagaattagagaccgcccccaagcagccggttaataataaggcgctcaccacccctataatgctatatgtatactttgcttgcatctctaatccctccattatgttttgattttaatcagatcaaccggcatcccgcaaaacaaaaagacgccctactaagctgttatgcttaaaaggacgtcttcacgcggtaccacctcatttgcgagccagtcagactcaccacttacatacggccaaatttattgacgatatgttggtacgttatcgggtacacccggaaattgcttcacgcaacttctcactagtaatcgacttttagctaccagttcagatcgcttttcatcatccgcgactcgctgtaactgactgataaccgactcctcgactgccgttcgcttaatctaattattttttaatgtgattcacatcttagcggtcatttttcaatttgtcaaatctttttttggaactttttcatgcgccgggtcattacgtttttaatcgcccgttctaattacgactgacaaagtagctctctcaaaccgcggcacgctattaaaaacatgtgataaaatggtgcagacaattatttttataggcaccttgatccccggatgattactattaccagtatttgatcgttcattacaatttcctcatcacggaccgtccaggggccttacataaacgcacattagcatcctgccatcacagtccaaatcatattgaccgattggtaaagatgatacagagccaacaaaaaagacccaccacacatggcaggtctacttgtatttaacgtttatgattacgaatcgcgcgctttctagctttttcaagcgttcgcttacgatcacgttcagcttgcttcttagcttcccgttcgcgattaatcttgaatgggttttgtaataacaaggtttgaccaacttggaacgcgttggaaatcacccagtacaaggacaacgctgatggcacgttaatggccgtaatcaaaataatcacaggcatcaaatacgtcattgacgttgtcatcccgttttgttctggctgcgacttcatcgctaaccaggaactagcaaacgtaaagatcgccgctagaattggcaaaacgtagtacggatccttgctacctaattgcaaccataagaacgaaccggtcttcaaggcttgtgtccgccagattgcttggtacaacgcaatcaaaataggcaactgaactagtaatggcaacatgctggccattggatgcacaccatgcttggcatacaacttcttcatttccgcttggagcttttgctgagtttccatatcgcgtgacgaatacttcttttgcaaagccttcatctgcggttggacttcttgcatggctaccatgttgcgggtttggaagatcatcaatggcaagataatgatccggatgatcaacgtaaagacgatgatcccgagaccataactatgaccaaacaagtttgataaccaaataatcgcccgtgagaagttcaagatgattaagccatcccaaaacccggtgctcttatccgtgattggggtattactacacccactcaaaactagtacgatcgctagtacggccagcattgccagtatttttctgtactttttcaaacgaatgtcctcactttaatcattgtccagcaggtgcgctagctttagcgcatggcttagataagctttggtttcggcttgcgacttaccagcaacggttggtcgggcaatgacgagaaagtctgcatcttgcttaagctgcggctttagctcggtgattgattgccgaatccggcgtttgacccagttacgcgcaacggcgttcccgatcttcttaccgaccgaaataccgacgcggaaatggggttgccccggtttttccaaaacgtaaatgacaaattgacgattggcatacgagttgcgggtctcaaaaacttgttggaactcagtttctttttttacccgatatgattttcgcataatccatctccatgtgtgcgctcaagctcttgagcgaattgctacacaactttacagccctaaacacctggtctaggactgtaaagaaaaagccactgattatcagtggcctatgcagacaatacttttctgcctcgttggcgtcgacgggctaacactttacggccattgctggtgctcatccgtttgcggaaaccatgtacacgttgacgatggcgcttctttggttggtaagttctcttcatcatgacacctccttctccataatgacatgaatcaattcgattaagtcgttattttcaaaacgcagtttacatctaaacgcatttcctgactactatagcatatttttatttgtttgaaaaccagtaaattaaatttctccgtagtaattcgaggtcaaaaaattatttaattgcgaatttatttgtggattatagcaaagtgactttccgttattcgcaatttacccacaagtttttcgacaaattaacgggttgttatttagttatccacagggcgtatttgttgtgtgtataactccaataaacgcttttattgcggctttagttttgaactcgcttttgtggataagtgctgttttataaaattaattcctagttttcgacaagctgtgtatattcaaatcccagcctgtgaattctcttaactttaacttgtccacttgtggaaaactctatatgttcatgctaaaatagaattacgttttttaagaaaaggggtatccac

SEQ ID NO: 176 - DNA, 1209 bp, Lactobacillus plantarum
atggaaacaacaaaatcgatatcgggaccaggtaaaagctacgtttctaagacccggattggggttcttgcagtcagttcaatgggcatggcggcactcgcaattaccccatcctatgcagcaatcgcatccaatttttcactcagtaatacgagtgtccagatgttaacatcattgcctaatctatttatgatgttagcagggttgattattggcaaactaacggcaaccaagctcaatctcaaaacattaacccttagtgcggcaatcttagtaattatcggtggttttctaccattagccttccacacaaacttcatgtttttgttattttgctcgtgcttagtcggtctaggtcaaggcgcctgcaccaatttatcacaagtcttaatttctcaaatgctaccagaaaccgaacgccagtccactatgggtttaacaaccaccttcaccaatctcggtggtattgtcttcatcatgggtggcggccagctagctgcaacgaacggttgggtaaataattattggatttacttattctcagcacttattttgattgtgatcttaacattagtgccgatgcatccggcagcagtcaatgcagccaacgatcaggataccggtgaacaaattaagctcaacaaatacgtctttttctgtgccttctggggattctgcacgttactcttaaataatgttttgaacaacaacatttcactatttgttgctgaagaaaaacttggcgcaacctcacaagccgctctaacgtcaaccgtttcattaattggggggatgctatgcggcttgattgttggcgttatcggcaagcggttcaaatactcatccatcacaatctcgtttatcttatacggcctgtcctacctgttaatcggtcttggacattcgctatggttagcctttgtaggtagcttcatcgtgggtgccgcaatgagtatcgccatgggacaatttccatatttgatctcaatttcagttggcaaaaacagtgtttcgatggccctaggtgtgtacgtcgcgatttactcaatcgggggtgtggtcagtcctttcatcgttaatccattgactaaattagttgctggtatgagtattaacgtcttcgtagtcagcggcgttattgcgctgatcctaggtgtactatgtatgggatttcagttccagaaaaaattagtaacggcggcacaataa

SEQ ID NO: 177 - DNA, 1506 bp, Lactobacillus plantarum
atgactaatcgaacaattgatactgatgtcctcattgcaggcacaggtggtacaggactagccgctgcatacgcagccgtgacccatggacttaaagtcaccgttattgaaaagcaatcacaaattggcggtaacacaaaaatctcaagtggatttttcgccattaatagccgtgaacaacgggaagccggtatgcacctaacaactcaggaggccattacacaattagccgactacaatcactatttgtccaatggtaccctacttgcgcggatcgttaaccgctcggcagataccttagcctggttggaaaaaatgggaatggaaatcaaactcaacccaactgccaatacgactcagtttgcgcatcgtaataatgattatcgtgggggttcctatcatatgtaccaacataaagacgagagctatcagcgcatccaacaaacattaacgactgccggtgtcaattttcactttaatacgacctttactgacctggtaattaccaacggagcagtcactggcgcaacagccatgaccgcttcaggtgaccagctaacaatcaccgcccacgcagtcgttgtggcaaccggtgggtacggtggtgatcgtgaaaaagttgctcgaaccatgcacaccacgcagctaagaaccttaggtgttccaaataacggtgaaggtctggctgctatggttaaagctggcggtactgacatcgacagccatgcgctcattcatgctgcgcaactagctaaatcccaagtcactcaaaagacttctcagcaacaccttgctggtttttccggtaatccattaacccaattattattaacccctcaactatgggtcaacatgcagggacaacgattcaccaacgaagatgtggtctacgataccgttgaatgggcgaacgctgcttggtctcagggtggtcaatatctctttatcgtggatcaggccacgctcaatacattcaccaccaaccgcaatcgcgaagaagtttctcaagcaggaccgggcgcagcgactggcagtggtgactttaccgcattagctgaagaagctgtcactggtaaaacagcttttaaggggaactcactcactgagctagccactaatgctggtatggatccttcaacattgagccagaccgtcgctacttataatcaagctgtcgcgtccaaaaacgacagcgaattcagtaagcgcttgcagtccttggattattcaattagtgatggtcccttctacgccttcatctgccaagccgcctatcttggtacggtcggtggtgttcgggtcaatcgaaatctcgccgttttagatgacgatttcaaacctattcccggtctttatactggtggcgccaatgctggtggttactatgagggacacagctatcctgcatttgaaggccttgcctctggctttacttggacgtcgggccgaattgcaggaacaagtgccgcggcttacgtcaaagcaaagttcgccactgtcaactaa

SEQ ID NO: 178 - DNA, 606 bp, Lactobacillus plantarum
atggttcatgatttaatgaatgcgggtgagcggacattgcggtttattgtttatcgccaattgcgaaatcagataacccaacggtactttgatttgttgacggagttagaacggcaagatttgcaagatgtttttattgattatcaacgagaaatgacggtgggattgttaatgacggaactattgcggcatcatgaggaacgcatctcgattacggattcttattttcctggtaaaaatattcgacatgttaatgctgatacgcaatcagggatgatttttacgtatttagtcgcacataacgcagatgcgacgttaaaagaaacggcatgttactttggatatgataaaaattatttttcaaggctgtgtcgacgactgttcaacaagagcttttcggaacaattaacatttattcgtattgaactggccaaacgaatgctggcattttctaataagcgaattgaacaaattgcagctgaattaggctataaaaataatagtagtttctttactgcgttcaaacgcgaagtggcgataactcccaatgattatcgtgagcagcatgggtatcggttagcacatcagcatatcaatgataattaa

SEQ ID NO: 179 - DNA, 219 bp, Lactobacillus plantarum
atgaaagcacgggtggttggtaattcaacgacattgacaattcctaaaaagttcaatgttgcgaatggcacagagtttgaagcagagcagctagatgatggttcgattttattcaaattgaaacatcgcaatccgttcgagggtgattggtttaatgaccaactagagcagtctgacataaccctggacatggaggacgtcgatagtgaatgggactaa

SEQ ID NO: 180 - DNA, 366 bp, Lactobacillus plantarum
gtgaatgggactaatcagtatattccacgtaagggtgacatcgttttaatcaattttaatccgagtgctgggcgcgaaatccaaaagtatcgcccagcattagttgttagtaatcaaaagtatgcgcgattaacaaagctagcgctagtttgtcccattacccatactgccaataaccggatgacggctttggggttgttgatcaaaatcaaaacaccgaaagtcgacggctatatcaatccactccaatttcacacgtttgattacgtccgtcgggatatgcgtcaggttggcgctgtcgataagcaaatattagatcagacactacaagttattaacgatgttgttaatgctaatgaagtatag

SEQ ID NO: 181 - DNA, 162 bp, Lactobacillus plantarum
ttggacagccttgaactttgtgccggtcgggcaactaagcaggcaatgaagcgtgcggctgaggaattggccaaacgtaagccggctaggaagacgaccaagaaagcagccacgaagtctcacaaaactacaaagaccaagcatgggacatcaaaagtctaa

SEQ ID NO: 182 - DNA, 543 bp, Lactobacillus plantarum
gtgctagtttacaatgcttttagtgcggtaagagatggaacatttgatcagtttaaaaattattattctggcaatgtggatgagactgataagtttgaaggacttaatttattatgcatggcaatgacaaacgatgacaatcctgaggaaaagttaaagattgttcattttttgttacaagcaggtattgatgttaactttgtcaccaagagtgaacatcgaaacgcattacattatttttacaattgtgtatggcgtccaaatcctaagtttgctatggaaattacgaaactattagtcgagaacggcatcgatgtaaatagcgttgataagtatggacatgtaccactgttttatgcggtttttgataatgatttggatactaaggaaaatgaagagttatatttttatctattaaaggcgggctcagattatcgtttgcgtgatccatttgggaaatccattatagattatgcacgagaaaccaacgagaggactgattttttagatattgtaaaagagtatgaaaacggcaaaaaatga

SEQ ID NO: 183 - DNA, 264 bp, Lactobacillus plantarum
atggcaacgattataattattggagtagtaattataggaattacgctgggattaggatactggagttatttactgggaaaaaggaatcaatctaattttgttggccctattattccagtagcttactttgctgttcgagcaatcttagctgtgatgacacaaactacgacacatgggctagtatcgtcattactcggtagcttgttattcagtttgatttactatggcttatttgttgggggtaagcaccgggccaataagtaa

SEQ ID NO: 184 - DNA, 1053 bp, Lactobacillus plantarum
atgcgaaaaaaggaaattatttttgggttattaagttttattgcactgggaacagtattagctggctgcggcagtagcagtgctagtagtaaggatacatctaaaacctataagtatggtgaagtaacgataccagctaaggacggttctatttgtaatgcgccaaattatatcgcgtatgagaaggggttctttaagaaaaatggtatcaaggccaaactagtagcgaacccgcgggatatcagtgacctagaagcgggttttgcgagtggcaaatatgacgcgcaaaatggtgattttcaatacttacctgcgattcaaaacggggcgcaaatcaaagctgttggtggaatccaccaaggctgtatcaagttgctggttccgaaaaactcaagcattaagagtgttaaggacttaaaaggcaagacgattgggattccggctcagggttcaacaccacaatacgtgacgtccattgcacttcaacatgcgggtattgatccgaagacgggagtaacgtggaaggtttacagcactgatctattggcaaaggcggctgaaaaggggcaggtcgatgcaattgggacggtcgatccgtatgcttaccaagcacaaaaggaatctgggtttaagaccattattgataataataacaatagtggcaatgctaagatggctgcaatgggaatgaaatcaaagggtgcttgctgttacttgtacgtttcgagcaagttagtcaaagagaatccagcgaaggctaaggccattgtccgttcatacaaacaagccgctgcttggatcaataaccatcctgaagagacagcaaagattgaattaaataaggggtatgtctccaagacgaagtttatcaatgtgaagaatgtgacccagatcttgaaagatgaacattttgaactaaatcttaagacaggtaaagaagatttaagttattatatcaagcaattgaagcaagcaggatatttgaagaagaatacgaataacaagcaattgttgaagcaagcttattggtatccagatttatctaagaactaa

SEQ ID NO: 185 - DNA, 1014 bp, Lactobacillus plantarum
atgcaaataacagcagtccaattgagtcgaaaaaaagttgtgcaggcagctaagacaactggccgttattggaagccctggcacttgacctggaacattgttagtttagtcgtattagcaattgcgtattttgaaaaccaattggttgtatcacaggaaaccgttaataatcagacgtatcattggtttttaggtgggtactttgcttatttattgattgttacgctgattggcgcagttacaaatggtcgaattcgccggtataatggacattttgcccagttgaacgtttcgttagttggcttgctgatcgtgcaggatcttctgaccgaaaagtttgtcgttctagaacagcctttcttcgtgagctttgcacaaatcttggaccagatgcgcgaaaatgccggcttgctctgggcttcgacgttgtcatcattagcgctttggttgattagttttgtgattgggaccattcttggaatcttacttggtttgggcatgggacgctatcgtgagtttaactactgggcattcccctacttgaaggtcatcgggattatccctgcggctgcatggatgccgctgacgatggtcatctttccgactagttacatggccgaagtcttcttgattgccttctcggtttggtttccagtggccttcatgacgattggtggcgttcaagggattagcaaggaatacttcgaatcagcaaagaccttaggatttagtgagtggcagattatccgcaaaatcgtccttcccggagcgttgccaagtatctttactggcgtttatacggcaatgggattgtcgtttacaatgctggtaatttccgagatgattggtgctaaggtcggactgggctggtttatcaactgggcaaagggtaccgggaattatacacaagtctatgcggcaattgtgattatggcgattctgttttcagtgttatttgcggtgtttaccaaagttcaagattactgcctacgttggcgcgatggtgctcactag

SEQ ID NO: 186 - DNA, 771 bp, Lactobacillus plantarum
atgggattacttgcagttcaacatgttaatcagcggcttcaagacaatgatggtcatcagatcgacgtgctagatgatattgatttcaccgtcaatccgggtgagttcgtagcaatcattgggccgtctggttgtggtaagaccacgttactacgcctgatttctggattagaccatcccgctagcggtcagctaacgatcgataatcagcagattaagcgaccagataattctcgcggttatgttttccaacatggcagcctttttccatggtcaacaatcaaggagaatattagtgtcggcctgaaagtgacgcgtggtcggcattatgaccaccaattggtcgaccattatattgaattgatggggctaaaaggctttgaaaatgcttatccgcatcaggtttctggtgggatggcccaacgagctgccctcgcgcggtcaattatcatgaacccgcagctcctacttttggatgagccgatgggggctcttgatgcgtttacacgtgcggatattcagaatgtcatcgaacaggtttggcagcagacacagacgacgatgattttagttactcatgatatcgatgaggcagtctacttgagtgaccgaattattgtgatgacgcctcgtcctgggagaatcaaagaaattgtgacaaatccattaccacatccacggtcacgtttgagtgtcgattttgctgaatttcggcatcggattcaagataaattaaactttggcgctcatgatggacaggttactgggtga

SEQ ID NO: 187 - DNA, 948 bp, Lactobacillus plantarum
atgggcgtgcgccgagcggaaattatcaatggcttacgatggtcagtagtagcggacgcattagggttgcccgcggaaaatcgtcaacggggaacttatccgttaattacggaaatggtcgcaagtgacttttggaaacagccagcagggagctggtctgatgacacatcgatgagtttaggattgattgagaatttggttagcggtggtgattatgatgatctcatgtcccgatttgagaactatatgcgctttggaacgaacacgccgcgtggtgaactgtttgacattggtcggacttgtgctcatgcaattcggaattatgccatcaatcagtttccggcccgccaatgcggtgatccttcggtgcatgcgaatggcaacggcgcgctgatgtacttagcgccgttagcggtggctctgcagaatgacacaagcgtcgcacatcgactgacgataactagaaattacacgatgttgacacatggtcatgctcgttcagttgtggcgagtctaatttatttggaagtgttgcatgcgcttcatcagggacaagcgttgcctgctgcactggtatcggtgcatgaattgctaatcagtacaatcaaggatatgacacttttaggtgaactgagcacatatggcgcgttattttcaccagacttcgcccaaacaaaagccggagtcattcggactagcggttacgttgtggataccctgttggccgcatgctggttagctttaaactaccagacgccacgggaagcggtgttagcggctgttaactttggcggcgatacggatacgattgccacgattaccgcggccttaactgctgcttggcatcctgatattacagtggatacgaagtggtggcaacaaaccttaaatcataaactgctcaatgcccattttgaggtatttactgctaaatttgcgagcagctag

SEQ ID NO: 188 - DNA, 1011 bp, Lactobacillus plantarum
atgacatacagtacagataaaccttttaccagtttagatgctcaattaaagatgttgaagaatcgtggtatgaaaattgataacacagattatgcaagacaggttttacttaataataattattacagtgtaattaatggctataaagatccatttttaagaaaagatggtgcaggtgaggctcttaagcctgagatgtttatccataaaactactttttcagatgtgtatacactatatggatttgacagagatttgagaaatatagtattaaattatttgttgatatttgaatcccgcttaaagtcgattataagttatgagtttgcacaaaaatttccagacccgtacagttatttaaatattgtgaattattccaacgatattggtgatctgtccaacgttctaaaaaacttaaaaaacctttcactaaaactcaacaggggaagaaatgaaaggtatggtaagcctagtattattcattatgttcagcaacatacccatgtaccgttgtgggtgctagttaatacgttgacttttggtgaaatacaatatctttatgactcattggatcaaaacctaaaggagaaagttgcgagagacttcagtgaatattataaattgcattggaaatccagtgaaaagattgatacaggagaattgaaatccttaattattgttgcaaatctgtttagaaatgtttgtgcacatgatgaacgtttttacaattacagcttaaggacaaagattccgaagtcgttgttcagcaagtactatatgaataacccaatgttcgatgacttagaaaagccagtagatttatttgcactcatatcgttacttgctttggttttgacacgtaagcagtttaaagcaatgacgtatagtatcaatagtcttatagaaaaaagcaattataagttaaagtcaattgggataggaaaagtgttagatttaatgggatttccagaaatacagtggagagaaaagatccaagttaaatctgactag

SEQ ID NO: 189 - DNA, 2205 bp, Lactobacillus plantarum
gtgtctacggctgatcaactagtattagatactcaacaatggttaaactccacgtacggtgacgtcgctggatttggtagtgttccagaaaatggtcttactggctgggacacaatttacggtcttactcgtggtttacagtatgaactgggaatcactgatttagttgataactttgggccaacaactgcaaagctctttgatgaaattgctgatgatattgtacctggttattctggtaatatcgcatatattatacagggtggtttctggtgtaaaggcattgattccgccgcttttgatggcgagttcactagcgatactgtatcggcagttacaaccatgaaggaatacgctggattaagtgatacatccggtaccctggattctcagttcatggctgccctactcaatatgagcgccttcaccctggttgcggatggctatgaaaagatccgtacgatgcaacaacaattaaatcatgactatctcgcctatactggcattctaccctgtgatggcgtttatcaacgcgatacaaacaccgctttgatttatgctttacaagccgaagaaggacttgataccgacactgcctctggaacttatgggccaatgacgcaagaactgactccaactgtttcaactggtgataataataatcttgttcgtatactacaatggggtctttatgtaaataatcaagcgtatacgggggcttttgatggcagttattctttagatgtatcaagctcagtagcaacttttgaaaacgatatggccctaccagaaacaactggtgcatcagcaggattggacgttttcatgagtcttctaacctctgccggtaaccctgaccgcgatgctgttgcttgcgagacatctcaccaaattgatgctagtgaagccgccgcacttagctctgctggttacaaatacatcggtcgctacttaactgggacagccggtactggaagcagtgaggttgataaaaacctaaccaccagtgaaatcagtatattaactaatgctggtttgaaaattttccctatttatcaagacggtgcatccgatgatgaagactacttcactcaaactaagggcagtagtgatgggcgtaaagctggcttagcagcgatgcaattaggtttcccggatgatacaattatctactttgccgtggacgtcgatattcaggatggtgacatagctggtacggtcgaaccatacttcactggcgtggcaagtgggatcagtagtttcgggtttcaagttggtatttacgccacaagaaacgtcgccaatacgattattgtggatggattagccgaaaaagcttttgtatccgatatgtctactggcttttcgggtaatctcgggtttccaatgcccagtgaatgggcctttgaccaatttaatgaggttgcttttgatgatttttacattgataaggtagcttctaacagtagccgctcgacggcagtggatgacttctcagctggtagtagcgttggtggaagcgatgatttagacgcaattaatgaaattattcagaaactaggcaatacaaatacttactttaattttgtgaaatccgtctcagttgaagcgtttagtgacacgtacacaatttcaacacccgctgctgatttttctttaaaagttgatttagaaggaagcattagtgacgacgatggtaccgtgtcagcgacatataaggtaaatgatggtagtaccagtttttctgttagtgatgcagtccaagagttacttacacagaatgaaactgcattaggttcatctgatatgacaaatgctatgaacgaaattgcgggtgtcataaaaaatggtgatatttcaagtaatacatctattaaaacttctctcatgacgattaccctgaaaattaaatcaacgtttgagcacactgccagcaatgggaaaacatattctattgaatatgaaattacacttgacattcacttccatgaattcatagcgcccctaccagttaatgttactcaaactcaggcaactgattataataataatctaaagactattttgagtattcccgcaaatgctctagactatattaataacttgcatccagatttacaattcacacccacgccagcttcaacagaatcgtccttagcagttatgatgatgttcattatcactttgttagcggctgttgcttga

SEQ ID NO: 190 - DNA, 1113 bp, Lactobacillus plantarum
atgaaatattgtccacattgtggcaattcggtgcgggagaaagctaatttttgtccaagttgcggtaatgctctggttgaaactagccatgcacaatcagtatcagatagtaacaatcaatttaaagaaatttacaataatgcaacggctaagttgaatcattatacaggtgaagagggcgccgttaaggttaacattgtagctttattctcagaagtcttcaaacaccacactaaagatgaggccaattctatttttattgcagggactaagacgactacacctgctttgtcggatgtttcagatgaatgggcaaagccatggttattttcgcgaattctgttaggatttttactcgcatttgtggtgttgctatatatggtagatggtttcagtaacagcaatgcgattcccggattgatcctggtgggagcctttgcagtcccgttttcaggcctagtatttttctttgaatctaatgcttttaaagatattagtctttttgaagtggttaaggtgttctttattggcggaattttttcaatggtcgttacattgtttttataccaatttgtcacttttagctcgactagtcagatttttggggttttgacactcaaggattctttatcaattggaatagttgaagagcttgggaaagtcttaattatatcttattttatcagccaattagatgtgcaccatgtgttagatggcattctgattggcgcggcagttggttctggctttgctgcatttgaaacggctggatacatttatagggcaaatgctcaactagttgcagtggcaatcttgcgtggctggtcggccgttggtggtcatttggtatgggcagccatcactggcggagcaattatgattgtgaaacgtgaccatccgtttaagtttagtcagttgttagatacacgctttcttgtatttttcgtcttagcagtattgatgcacgctgcgtgggactggaacattaccatattgggcagtaattatctcaagttaattttattgattgggctagcttggatcgtggtatttgtgttgatgaatgcgggtctaaaggaaatttcgcatttgaaacaacaatcacattcttaa

SEQ ID NO: 191 - DNA, 2952 bp, Lactobacillus plantarum
atgcgtcatttggggaaagtaccagtttggattacttatacagtagcctttattattttaacttgcatcatttatagtccactatttctggacggacggtctttgatttggacagtagatgggatttcacagcatttgccaatactaacagcattccaaaaaatgcttaagggaattggcacacaatcattatttggatggtcctggaatcttggcctaggagccgatcaaatgacgacttttgcgtattacgttgtcggcgatccattcaactacttagtcgctctatttccaactactaaaattgaatttgcatatcagtttctgattttgattcgcttatatgctacgggcctagcttttttaacatttgctaggatatggcactttagccgcttaagtcttttaattggttctttaacatataccttcactgcttttgcacttcacatcggcatgcatcatcccttcttcttattacccctcatctttttcccattattatgttggggaattgagcgagtattcagaggaaaatcatggtggcccctggcaatagtaattgcaatcacggttgccagtaacgtttactttgcttacgtattagcactcgggagcgttatttacacaatctggcgttattggcaacaatatcgtcaaacaaaaacgtatgcacgattttggcaattgatttaccacttattaagcgctgttttagtcggtgtagcgtgtgcagcagtgttagttattccgaccgtcctcgccatgttgcactcgacacgtacaggtggccaatttgccaacggattatcgctctacccattaagttattatattgcgctacccaatttggttttaaatagtgatgggatgccgttttgggtcattttaggtatcagtagcctaacttggttagctattttacattcgttacgtcattttaaacaacgatgggacttaaatagtctactcattattttattagtaggcctattacttccagctgttgcagccacattcaacgttctatcttcgccctccaatcgttggctattattaagcactttgctgttcagcgttcttacaatgcgactcatcgatgactggaaaaaacttgatagttgggattaccgactatttctaggcgccagtgttggcttaattataattatttgggtcgtaaatggttttacttttaacgttagtgcgcgcgacctaatatcatatatattactattcgtcttaatcacctggtttatcgggtcaagtgcgatgcatttaagccgcttaacactgataattggctgtttcactctgctatgtcttaatctaattaatactggctttggtgcaactatgaccagttccggagttgccaatccacaacaactatatcgtggaagtgccacgagttggattaataaatatttggatggtgctcaaaaagctttaccgcgtaatgataatttctatcgaactacattaacccctggattctatgctagaggagctgcttctggaaagaaaaacatctcaatgttgctcggcacccatgatattgcatcctatttctcagtacagaatagaagtattagccaattttcacagtcaattggcaatcaagaggccgatcctaattcaccactaagcacagctgatggtcggacaacaacacgcaaccttctgggggtccgttatatatttgaactagcagaccgttatgaccctaaaaatattcccgtaggctatcatgctttaaaaaacaacgatgggcacgtgcgtatatttaaagatcaaccagtggccggtggattatctaacaaaaccggaactatcgtttttgttaatgacaactttttaccattagtatccacgcaaaacgctcagattagcgcagccaaatatcaacgattaaatgctgttgataaagagcaagcaatgatacaagcgccgattactgataagccaataactggtgttaaacaagtgcaacctcaaaaaatagccaccactgtcccctataccgttaaagttaggaatattaccgacaggccagtcaactcttcaagccgactaagccagaaattagtcactactaataaaaaaattgttaatgacaatcaaaccactaaccaagatggtctacatcaattagttagtgattgtcagggacatcaattgacctatgatttaattcttgatcatcctgaaaagtggcaaaataaagagttatatttagaggttagcggtatgacaatggtcaaacctacgttgaatcaatttttgcaaaataatgcggctaatgccgtatttgctaatcgccccaatacaacattagctaagattcaacagtttcgccaggcacttcatactgattggcaactcagcggttactatttatccgcatcaaccgcttatcgaagtaacaacttttcacaacaatcaccaactaatctttcgaattattcgattcgaaaacgtgttattttaaatttaggctattcaagtcatttacgaagaatcgtgaccgttcgttttagtcaagtgcctgaactaaaaatccatcatgtaaaattaatggcagttggatttaaggggcgctaccagcgtcaaatcaaggccattcaaaagcacggccttaaacaacaaaaggtaactaacaacaccattacgggtcgcactcaagcacaaactgccagcgtattaactacctcgattccatattcaactggttggcacttaacagttgatgacaaaccaactaagactcaagttgttaatacaggtttcgttggtgcaaaaattcccgctggtcagcataaagtcaaattacaatatcatacacccggattacgattgggcgctataatttcgttaattggccttttgcttctactggttagtatcctttggcaatcacacgcttggttgcataatcaatcaaaccagtaa

SEQ ID NO: 192 - DNA, 864 bp, Lactobacillus plantarum
atgcgtttgggaagtattgaagctggagggactaagttcattttagcaattactgatgagcactaccgtatcttgaagcgacaacgagtagcgaccacaaagccaaatgaaacgctggcagcctgtgtttcattttttaagaaaaatccagtcgatgcgttgggaatcgggagtttcggcccagccgatattaaggtggattcaccgacatatggtcagattttaaatacaccaaaagctggttggtctcatacggatgttgtacagatgttgagggcagctttgaaaattccaattacttttacaacggacgtaaatgcttcggcttatggtgaatatatgattggacaaggacaagcagtgcgttcactagtatactttactattgggacaggcattggtggcggtgttatccaagataatcatttcataggtggtatgtctcatcttgaaatgggacatacaatggtcatacctatgtcaggcgataacttcaagggtgtctgtccatatcatcaaaatcggtgctttgaaggcatggcttcaggacccgcaattgaggctcgaactggcaaaccgggggaacaattgaagcgaaccaatgaagtatttaagttgatcagttattatattgcacagctggtctttgatgcatatcttaatttcatgcctgaaagaattgttattggtggctcagtagtaagcgaaactgaacttccagtgattagaagagacgttgagcagcttaataacaattatgttgaattaccgaacttagatcatttgattgttttaacgggaattgctaataatggttctgcaacgattggtaatgtcgccctggccaaaaatttgatattttag

SEQ ID NO: 193 - DNA, 2559 bp, Lactobacillus plantarum
gtgctaagtgatcagctgttctcaaatgttttgaaggagttagaaacgcatcctgaagctaattttactttagacggacagacatcaatactagatgagtatgttgaaatgcatcccgaagatgttatccggataaagaaattaattaaccgtaatcaattatttgttggaccatggtatacacagactgatgcgatgatacctgatgcagaatcaattattcgtaacttagttattggcatcaacgataccaaacaaaagtatgggcaaccaatgatgattggctatttgccagatacttttggatttaattcgcaattgccaatgctcttaaatcaagttggcattaatgactttattttttggcggggcactaattttaagcgacaaatggactctgtttattttaaatggcacagtctaggtcatagtcaagtctatgctgctaattttccgttaggttactatactggtcaaatcgcattggattcgaagaaaaacttacaagagttcgttgcaaaccgtctagatccaggaattgattttgaaagtcaacagggtcaaaataattcggtcctagtgccttcgggaatcgatcaaatgaatattattcataacgtatctgagactattagtaagataaataaatatagtcataatcagattgtgatcagcaattatccgaagtttatgcgaacattacgacaacgcaacgatttaccggattatcaaggcgagttgcggtatccaacttatgctagagttcatcggacaattggttcagtacgttcgcgcattaaacggcagaatttcaaactcgaacagcaaatattacgacgtgttgagccactgatggtcatcgccaaaagatgtggtatcgatgtgtctaagggtcttattttgaaactttggaaaaagttgctagaatgtcaaccgcatgacagtttgggtggcagtgtttctgataatgttgctattgatattgaccatcgattcaaacaaggttttgaaattgcagacggtatcgaaaactatatcaagaaaagaatcgcacaacggttgaaactggatgccaatcaggtgcttgtattcaatactgatccacgcccattcaatggatataagaaaatccgtttcttaacatcatcgaaaaacattatgtttgatgaaaaatatcaagcaactattttaagtgcaaattatgtggctaagcgagaaaatatcatgcaacaaacggctaaaggctttgaatttaaagacgagcctggttactatgaattacaagtacaagttgcagtccagtttgatgggttgggctaccaagtaattgactttaaggatggtgcagaagctttgccagaattacagtctgagcaacaaacggctatccaaaatgaaagttggaaagtgaattatgtcgatggcaactttcaggcaactactaatgggaaaacttacaaaaacatcattagtattgtagattcgggtaatgatggtgatacgtacgattattcaccgcttcgaggcgacaaagaggttgacttgcctttagccggcgttgtagccatttatgttggagctggaaggcaagaactgcgattaagcggcaagtggcagttaccagaaggcttggctgacaggattagtcacgaaccaaagctgcacgatgtcgcatttgaattaacgttgactttaactgatggtgacaatgtattggcaggtcgtttaactgtcgataatcaggttctagatcatcgattacggttaaaaattaatacagcaattgaaagtgacactgcagttgcgcaagttcaaggcggctttcaaagaacacgtaatttaccaattgcggaaaattgggaagaagaatttgttgaaaaaccggttaacctttataactttgataaaattgtcgggatgcaaggggctagcgatggcctgtatttaattgctaaaggaatgaaggaatacgagttaggaaagaaagcattttatgtcacattaatggcaaccactggtcaacttggtaagcctaatttactgtggcgaccaggtcgtgcttcaggcgatacaactagtattgggcatcagatgacaccaacgccgttggccgaagaattaggagcaaatacatttgagtttgggttagtttccacgtctcaattgaatgaaaataaattggcaataattgctgaaaagtggttagcacccgatgttagttatcaattacaaaaattgaatttatttgtaaatcgattagacaataaaatttgggatgttgaatttgatgattcattaccaactatctcagagtgcgagtcatttttgaaactcgatccacatgtcacaattagcgcgttgtatccggcctatactgtgccaaatagttttgttatccgtttggcaaatgaatctggtgtggctgctgatttgacccccttgttaaaacaacatttcattcaggtaaatgctctggaagaggctcaaccatgttcggaacaattagtgattcagccttatgatatggttaccttgctcatacacaatcagggggcatag

SEQ ID NO: 194 - DNA, 1101 bp, Lactobacillus plantarum
atgaagaaaatattggctgagtggaagggctacttaatgtctggtatttcatatatgttaccggttgttattggcgggtccctcgtagttgcagttcctaagttgataggtctatgttttggaattacaagttttgatgcgtataaaactggtttttggttttatatgggacaaattgaagccgttggttggattggtgttggcttagttaatttagttttggccggttacattgcatatgctattggcgataagccagctttagccgccgggttcattgggggctcattagcatctagttctaatatgggatttttaggagccttggttgctgggtttgcagctggttatactgcacgttggtgtcacaataagttacatgttggtgaaaagttcgaatctattatgccattagttgttgtaccgctgctatctacaatggttgtggcaatattgatgggagtcattttgaagcaaccgctgacttggattaatgtatcacttgtcgcctggattaaacaaatgagtacaagcggtgtaagtgctattaccttagcagttatcatgggcgctatgattggttctgacttaggcggtcctgttaataaggctgcatggatggcaggaaacgttttattagctgaaaagatttacacccctgcaatgatcgttaatgtggctattgctggtattcccttaggatatgcatttgcgacgactttctttaagcatcgtttttctgatgaattacttgatgctggacgaagcgactggttcatgggatttattggaataacagaaggtgctattccgtttacattagttaacccgttgaaattaattccaattaatatgattgctggtgctgctggttcggcgactacgattttacttggggctcaggctaagattcctcctgttggtggggtttatggatttgtcaccattacgaatggttgggcctatttaatcggtctaattgtttgcgctgcgattatcggtgtactggcaccattggctgtggactttaaccaaacacagagcgaagaacaagtcactgatgataatgaggacgacattaacattaattttgaagcttag

SEQ ID NO: 195 - DNA, 321 bp, Lactobacillus plantarum
atggattttgttgcaattacatcatgcccagcagggttagcacatacaccaatggcggcgaaagcgctagaaaaagcagcgcaggaactaggtttacaagctaaagtagaacaacagggtgcaatgggacttaaaaatgaaattacagttgaagaggcgaaaagcgcaaagtttttattgattggttcggatcaaaaaattgaaaagatggatcgatttgaagggattccagcagttcgagttgatattaatatgtgtattaaaaagccgaaagctgttattgataaggtcagcaaagcggttgctgctcgtgttaaataa

SEQ ID NO: 196 - DNA, 462 bp, Lactobacillus plantarum
atgacagaaatttttaaacagaagtatatttttttaaaagaacattttagaacacgtgaggatgtttttagctttattgcacataaagcaattgaacttggctttgcagataacgaagatgcagttttgaaagcgctgtatcaacgagaaaaagaagcttcaacaggaatgcaggacggtatagcgattcctcatgcaatctcagaatatctgcggcaacctgctgtactattcattcgctctacaacaagcattcaagattggccgacatttgatgaccaaccagttaatcaggtaattgctatgctagttccaaaaaatagtgagcaggcacacttacagattctagctaactttgcgagtgcattagtggatgaccgtgagcgtcaagcattacttgaaagtcaaacagttcaggatgtttacactgtattaaccaatagttcggaaaaaattttataa

SEQ ID NO: 197 - DNA, 1905 bp, Lactobacillus plantarum
ttggcgccgaatagttcaccagcaactcttacacgaatgattattgagttgatattgtcaaaaaggatagttcactatcaagatattatggagtatacgggcacatctcgtaagacgattgctaagtatctgaatgaggtggaaaaggtagtcaaccaacaaggtgtacaccttgttaggaaaagaggacagggtattcgttttagtggtaatacgaagggactgttggctgagtttccgatactgaaggataatagccaaagtgagcaagaacgcagaattagcattatgacattcttgacacagcaatctaaaccagtgttattagatgatattgctgaccacttctttattagtcgtagtacgttggaacgtgatttaaatgttttaaaaatggattatgggttgaagctgacggccactacagaaggtgttaaattcaatagttcggagagtgatgttcgtcgagtgattggtcagctattacagtcatattggggacaagagattaagcaaaatcaacagactggcaaaatgacacgcacatttaaagtgccgcagtccctgaaacgatatgtcaataaacaaaccttaaatcagatgcaaaaagtcctgaataaatttgtgaagattttaaaagttgatgtaaatgaatatcaatatgagtctttactgatccatacaactattgcgattcagcgaattaagaatggcgagtttattactcaaacgacgacacagaattttgacactatggcaatatcttcgagtaccaacaaattagttaaaatgcttatcgtggccttcaagtgtgaaattcccgatgaagaagttgcttatttaaatatgcatgtcgcggccattgaggatgggtacattgatctggatagaagtggcttagttgaacgaacgatagtcgactggctacgtagcgtgctaacggattatgataatcaattattacgtaatctaacgctacacttacgtccggcgctggttcgcattaaaaatggcattagtattacgaatccgtattgtaatcaagttaaaacgtattttcccgtcgcttttgatcaagcactagcattagcgatggcgattgaaaagcaataccatttacagctaactgaggatgaaattgcatacttagcactgcactttgaatcgttcattgagcgccgaaagatcttaaaaccagatgttgagcttgcaattgtatgcagcactggttatggtacggcggagttactaaagcaacgtgtcatggacaaactaccggatgttcagattgttggcactttgtctgtgaatgagttgatgacttcaacagtgactgcagacattattatttcgactatcccgttaaagatgagcggtacgagggttattcaagtcagtccgtttttgaatgaccaagaactcagcttattggaaaagttaagtcaagatattcgtcaagaaaagtatacgcggaacgcatttgttaaattattaagtccaaacggtattattacaaattcaaaggcaactgaaaaaaagatggcgattattcaactaactgatcggctagaaaagtatgggtatgttgataatcaaatgcaaaattcagcgttagcacgtgaacaagttgcatccaccattatcgataaatttgcaattccccatggtgatatcgaccatgttttgcaaccaacgattggaatcatgacgtcgaaaaagggaattaaatgggatcacgaaaatgtccatattgtatttttcgtagccctgaatcgcacggttgaaacacaaatggatgatatttacagttatttctataatttgattcaagatgggcagcgaatgacggccttaataaaggctcaaaatgctcaagaaattattgatacattagcacagcagtga

SEQ ID NO: 198 - DNA, 198 bp, Lactobacillus plantarum
gtgaagaaaatcaaaacacacgatgattatcgccatcacaaaagtacaaccatcaatcacttttatgaaaagctgctgaaattagcaagttcaatgaataccagaacgggaaagcaagaagccagtcgtcgaacaaagtatatgcgtgatttcttatctgaattccaaatggaaacaggtgtaaaagatgaaacataa

SEQ ID NO: 199 - DNA, 438 bp, Lactobacillus plantarum
ttgagcggcaacacgaaatattttattagcagactgacaacatactttgagaaagaacgtcatgttcgggttagttcaattaatgttaaagaacaccctgaattcaccactcttgaccagccgtttgttaccttcctaccagcctttcttaaaggtggtaatggggttaataacggttatactgaaatattaaccactattttgggagattacctcgcgtacgaaggcaattaccagcattgctacggtattatcggtagcggtaatcgtaattttaataagcagtttgcactcacggctaaacaatatgctaaacgcttcgattttccttacattaccgattttgagctacgtggcaccgcacacgacattcctcgcattgccgatgccattttaacctatcgcaatcaattttgttttcaaacaacgaaggagtaa

SEQ ID NO: 200 - DNA, 2169 bp, Lactobacillus plantarum
atggtaactagcaccccagaaatggaaaatacctatttttacttaaataacctcgtaaatatcccaagcaacggagaaattccgctacattatgatcaagaagccctaaaggcttatttcgaagagacagttaaaccgaagaccaagcaatttgattcgttaaatgccaagttaaattacttggttgacgaagattatatcgatccaagtatcctggaacaatactctcacaagtttgtgcagtccttgttcgaccaaatgagagaccatcactttcgttttcgcagctttctcggtgcctacaagttctacacacaatatgccatgaaaactaatgatggccagcaatttttggaagactttgtcgatcgcgtcgtcttcaatgccctctatctcgctaatggtgatgaacaacttgccaatgacattgccgatgaattgatttcacaacgttatcagcctgccacccccacgtttctcaacgcgggtaaaaaacggcgcggtgaaatggtatcatgttttttaatcgatgtggccgactccatgctctcaattggacgcggcgttaattctgcccttcaactatctcgaatcggtgggggcgtcggcgttaacctgtcaaacttgcgcgcctcaggtgatcctattaagcagatttccaacgcctcgtctggcgttgtaccagtgatgaagttacttgaagactcatttagctacagtaaccaactcgggcaacggaacggcgccggagtggtttatctcaacgtcttccatcctgacatcttacattttctggataccaaaaaggaaaatgcggacgaaaaaattcgggtgaagaccttgtccctcggtttgattgttcctgataagtattatgaattactcaagactaacgaaccaatgtatctttttagtccctatgatgtcgaacgtgaatatcgtacgccatttgcttacatcgatatcaccaaagaatataacaacatggccgctaaccccaatattaagaagtcagtttttaacgcgcggaaactagaacaaaagatttctcaactccaacaagaatctggttatccttacatcttgaacattgatacggccaaccaaactaaccctgtcgatggcaaaattattatgagtaacctttgtagtgagatcttacagcctcaagaaccgtcaaaacttgatgatgacctatcgtacaagacaactggcaccgatatttcatgtaatctcggatcaactaatatcatgaatatgattgactcgccggacttcggtcactcagttgaggttgctgttcgtgcgctcaccctcgtaactgacacaaccgacgttaaggaagtaccgactgttaaacatggtaacgaactttaccacacgattggattaggggctatgggtctgcatactgcccttgcacgccaccaaattgagtatggctcaccagaggcccttgaatttactgatgcctacttcctagctttaaactactattcactcgttacgagcaatcgaattgcccgtgaacgccacgaaaccttcgctaaatttgaccaatcaaagtacgctgatggcagttacttcgatcaatacttgaacgcagactttaaatttaagagtaccaaagttgcaaaaatcttcaaaaatattaaattaccatctgttacagattggaaggcactcaagcaagctgtgattactggcggcctttatcatcgtaatagactcgctgtggcaccgaacgggtcaatttcgtacgtcaatgaaacaagtgcatcacttcatccaatcacacaattagtagaacaacgtcaggaaaataaggtaggctcaatcttctatccagcaccttacctgtctaacgaaactttgccttactacacacccgcatatgatattgatcaacgaaaaattattgacacctatgccgtagctcaaaagcacattgatcaaggcatgagtctgacactatttatgcgttcagttttgaaacctgacctttacgagtggaaggataataacaatttaaagatgacaacccgagaccttaaccgattacggaattacgcctggacaaaaggcattaagtcactttattacattcgaacgtttacagaagacgatgaaattaaaacggcaaatgaatgtgaatcatgcatgatctag

SEQ ID NO: 201 - DNA, 927 bp, Lactobacillus plantarum
atggactacttatactacaaagcaattaactgggatgatattaaagataatttcgataaatacatgtgggaacgactcaccactaacttttggttggacattcggattcccatcacgaatgatcaaacggcttggcaacagctatcagatactcaacaacaggccattactcgtatgttggcaggtacatcaatgttagccgtctaccaatcagaagttggcacccctgctattcgccacgatcggcgaactcaacaagaagaatccgtattaaacaccattacctttatgaaatcagtccatgccaaaagctgtacgaccattttccgggctctgattccgggtaacggcggtgaaagttttacttgggcagatgacaatgccaatctgcaagctgaaattgaccaactagcccaaatgagcactagcgatatggccttacagaaaaaagccctttttattctgactgaaactgggctctcgtttggtaaatactggacaatacttcaaacacaggctctcgtcaatacttaccaaatattggctaatattctccgcggtagcgccctttttagtgcttatattggttacaaatttcgcctcagatttgaagaactcactgtaagtgatcaaaccgaactgcagtattggattaatacacagtttgatcaactcatgcaaactgaaaaagacttcttagaagctaaccttgacgatgccaccgaagccatcaatctggcctcctatggtgccaatcatgcattaatgtcacttggctttaacgctgtctacgaagttcaaccgtcttcactagtggcgcaactcaaagaactgatgattgaccaaaatcaatttttgcaacaggtaacggctgcaaacaatgaatcggacactgaaaaaatgaccgatgacgactacgacttttaa

SEQ ID NO: 202 - DNA, 951 bp, Lactobacillus plantarum
atgagctataaaacaattaattgggacatcatcgaagacgaacttgacgaatatgtatgggataaagcaacggcacaatactggctggatacgcgagtacctgtttctaatgatttacgggactggcggacactctctggcaccgaaaaatcggttatcaatcgggttgtgggtggattagccttgctggacacactccaatctgaagaaggagtcgatgtgatgcggccagacgttcggacacgaaaagaagcagcagtcctcaatgactttttgatgatggagtcaattcatgccaaaagctacggcactattttgacatctttgaacgatcaagccactgttgacgaagtattcaaatggatgaacaataatcccagaatgcaatacaaagccaaacggatcaatgatatttatcaaacgggaaacaaccttgaaaagaaagttgcaagcgtctttcttgaaggaattttgtactacaccaacttttttaccccactttggtaccgtggtaacaataagctggcaaatctttctgaagtcatcaaactggtgatccgcgatgaatctgttcatggtacttacctcggctacaaatttcaattgggatataacgagctatcggcgactgaacaaaaaacattcaaaaagtggatggatgagttgctcgacgatctccttgagaacgagtttgcgttcaccgaagaagtttacgcgccgattgggttagcggaagatgttaaacaattcgttcactacaacgccaacaaggcgctccaaaatatgggctttgaatcccgcttccccaatgctgagattaaagatatcaacccaatcgtaatgaacggaatttcaaccgaaacggccaatcatgatttcttctcacaagttggtgctggctatctaatgggtaatgctgaagctatgagtagcggcgactatgacttctaa

SEQ ID NO: 203 - DNA, 630 bp, Lactobacillus plantarum
gtgacgttaaagcaagttaagcggattatgagcaagctaggcattcgttgccaggttcgtcagaaaaagcattcacgaatcaaacaacaggagcaatacttacaagataatgttttaaatcagcgttttagcgttaaccaaccaaaccaggtttggttagctgattcaacggaattgacctatggtgttaacggtcagtataaagtgcgtttgagcggcgcgctggatctttacggtcgccatctaattgcccataaattaagtgaaactgaaacttcgaaggcaaaagttcaggtttttcaacgggcctttaattttgcgggtgacgtccaccctgtagtgcatactgaccgaggttcggcatgcacatcaggaacattcaataactttttggcgcaacatgaagtcacccgtagtatgtcacgaccaggaatgccgtatgataacgcaccaatggaacgttggtggaacgagttcaaattgcgctggattgatcgacacgctaaaccagttacctataaagaattagtggccttggtcgaagaaggcatcaactattttaatcaactagattgttcaccagcaagaaacgacctcaccccagctgaatactggaatgaggccgtttaa

SEQ ID NO: 204 - DNA, 633 bp, Lactobacillus plantarum
atgaaaattggttatgctagggtgtcgtctgaaaatcagaatttagctcggcagattgaagctctaaaaaagtctggtgtagagaaaatatttcaggaaaaagtttccggaaaatcagttcaaaatcgccctgaattgcaaaaaatgttagagttcattcgtgaaaaagatattgtcactgttttggatttagatcgacttggtagaaatgctcaggacattactgacaccattaacttgattcaacaaaaggaagccacactagatgttttaagtttaccgagtttcactgatatacaagatgttaacttacgtggtttattaaccaatttggtttttgaaatatacaaatatacagctgaagaagagcgcaacaaaattcatgctaggcagaatcagggaatccaattagctaaggagcgcggggagtataaaggaagaaggcggcaatatagtccacatggatcaaaacgctacctatataaaagggtagttcaaatgctcagggatggaacgaatattgcacaaattgcaaggagtactggcgtacaacgacgacaaatttatcgtattaaagaatatgctttaaaaattggagacttaggcactcccaaaagggaagtgaatagctag

SEQ ID NO: 205 - DNA, 903 bp, Lactobacillus plantarum
atgttttttaaagattggacaaaatacaatagtttcgaattaattatgattacgttgggatgtagcatttatgcgttcagtctagatttagtctctattccaagtggcttggcagacggcggtctgagcggaataactctgattattcgtcatttctttcatattaacttgggaattagtactttatttctgaatattccattgatactaattgggttgcgctacttaggcaagcgcatgatggcttacactatttatggcaccatttgtttatcactatttctaataatatggtcacagcagcctctgatccaaccactaccattgagaaatgatttattattgtcatcactggttgcaggggtattatcagggttgggaattggtctggtttttcgttataacggaactactggtggtagtgatattattgctcgggttggccagagaagttttggattttcttcgggaaaaggaattttgattattgactacgtagtattagggctatcactatcatacttagatctgtatcacatcgcgtactcgctaattgttagtttcgtattatctaaagtaattgatatggtccaagaagggcccaatcgtgctaaggtattattcattgtatcagataaaagccaaaagatttcccaattaattgatgtttctttaaatagaggattgacatatttgcaagctgaaggtggttatcagcatgatcaaaagcaagtgatttatttggtggttcaaccgcgggaaattccacaattgaagcaattaattaaagcgattgatgaacgggcatttgtgacggtactggatgcccatgaagtgattggagagggctttagttatcaacgcaaaagataccatgttaattggcagcacagtaaagaataa

SEQ ID NO: 206 - DNA, 1155 bp, Lactobacillus plantarum
ttggaatttttaggtaccttggtgatcatcttgattgcaactagtctatttggccatctagcctctagggttggtatcccagcagtgatcggtcaattatttgttggaattattcttggccctgcgttgttgaattgggttcacgccaatgattttatccatattttttcagagattggggttatcatcttaatgtttatcgccggacttgagagtgatcttacattgcttaaaaaatatttgcgtcctagcataattgtcgcgttgttaggagttttgattccaatggtactgatctatccagttggtattgtttttggcttgacacaatttgaaagcttgtttttgagcgttatttttgccgcaacgtcggtttcaatttcagttgctgtcatgaaagaactaaatttacttgatagtaagagcggttcaacagtcctcggtgccgcggtggttgacgatgtgctagctgtcgttttacttagcattatggtcagtttaataggtacaaaggctggtacggatacccagataccgctagctctgacttttttagagcagctaatttactttgccgcaatttatttcgtgatgcgttttatcgcccctctcctcgctagactaggcaccaaattattgaatccagtgggacctactataatggcgatgattttgtgttttggtatggcatatattgcaaatctgattggactgagtgcagtaattggggccttttttgcaggaattgcgattgcacaaactcatgtagctcatgaagttgatcaaagtatcgaaccaatcggttatgcgattttcattcctgtattcttcgtttcaattggtttaagtatgtcactagctggcatagaacacgatttgttattaattatcgtattgacaattgtggcaacactgacgaaactattaggagcgggaagtggggctaaatgggccggattcagttcgaatgaagcttacctcgttggtgcagggatggtctcgcgtggggaaatggccttgattatcgctcaaataggctaccaatccaaactaatcagtgatgattactattcggcaattatcactgccattatcctaacaacgttattagcaccattactactcaaacatgcggctcgtcatataaactactaa

SEQ ID NO: 207 - DNA, 1380 bp, Lactobacillus plantarum
ttgttgattggcatcaaccttggtttagcgttaattgtggctcgacttctcaagagagaaccttatatcgctggttctggaattccgcaagttgaaggtcaattggctggtgaattggaaatgcactggtggtcaattctttggcgaaaatttatcggtggtattctggcattgggacctggattatttctcggacgagaaggaccgtcgattcaattaggtgcgtcagttggtcaaggcttcgcttctgggtttaagttatcaggaactgatcgccgactactaattgcatcaggcgccgctgctggattagcagcagcgtttaatgcccccattgctggaactctatttgtcttagaagagatttaccataatttttcaccgctggtttggttaacagcattagccggagcaattggttcaaattttatttcgctgaatgttttcggacttgttcccgtgttacatttaagttattcacgtagtttaccagtatcaaattattggcacttaattttactcggcattgttttgggattatttggttacttatatcaacgggtcttgttagttatgcctaggtggtatcatcaattgacacatttgccacgcccaatacaaggtatcgtaccatttctgctggtaattttagttggttacttttcgccaaatttactcggtggtggtaatggcttaattgttggatttggccagtatgttccacctttgtttgtactaattgcaatttttattatacgattcgtcttttcaatgatttcatatggttccggattacctggcggtattttcttgccgattctttctttaggtgctgtgattggtgcggtttatggcgtcttaatgaatcaattaggattattatcgcatgtctatatcatgaacctaatcattttttccatggccggttactttgctggaatcggaaaagctcccttcacagctatcttgctggtaacagaaatggttggcaatttaacacatttaatgccattagcagtcatatcgttaactgcttaccttgttgttgatttattaggcggtgcaccaatctatgaagcattgcttaagcagatgacaatgcctaaaactgttcagcaacttcatcgacctgatcatttggaaataccggttttctttggcagtcccttaaacggcaaaatggtccgagacatgccatggcctaaagaagcactgctcattggaatccggcgtggcgaacaagaagtgattccacatggtgacaccttgattcatgaaggtgatacgttagtactgttaactgatacaacccaacgaccccaagttaaacaacggattgatgcattattagcaaccttagaaaaaaagcaccaagactaa

SEQ ID NO: 208 - DNA, 888 bp, Lactobacillus plantarum
atgcaaggaattcttttcgcgcttgttccaatttttgcttggggttctatcggattggtagctaataaatttggtggtgatgctaatcaacaaacacttggaatgactttgggcgcttttgtttttgcacttattgttttcttattccgcatgccaacgttgacatggcaaattttcttaattggatttattggtggattgctttgggcaattggacaatttggtcagtttaaatcaatgaaatacatgggtgtttcagtagcgagtccactttcatcaggaagtcaattagtaattggtggattgcttggggtttttgctttccacgaatggacaaaacaaattcaatttattctcggatttattgcgatggctgttttggtagttgggttctatttctcagctaaacgtgacccagaaaatgcagttgttaaagaaggacgtaattatactaaaggattgactgctttaacttactcaactttgggatatgttagctatgttattctttttaataacttagcagtactttggttcaatgttcattttgatacactgacaattaccttgccaatgtcagttggaatgatctttggagcacttgtgatgggtcgtttcaaaattaaaatggaaaaatatgtttatcaaaatatgattgatggagtaatgtttgctgtaggtaatatctttatgcttatggctgcaagcgctgctggtgacgcaattgccttttcattctcacaattaggtgttatcatttcaactattggaggaattctcttccttggtgaaaagaaaaccaaaaaagaattggtttatgttggaattgggattgttctgttcgtaacaggtgcaattttacttgcaattgtaaaatctaaaggatga

SEQ ID NO: 209 - DNA, 450 bp, Lactobacillus plantarum
atgttagaaaaaaacgcagatttaggagactacggtccagcaccttttgcacctgatttaaaattggctgccttggaaaatgaaaattatcgaactactttgtggaccggggatcattttcaaatcacattaatggctattccagccggaggtggtgatattggtatggaaattcatcatggtaatgatcaatttatttacttagtagccggtattggccacgttaaaatgggaaaagataaagatcatttaacagttgatcaggaaattcatcccggagaggctgtaattgttcccgataacacttggcataacgtgatcaacgctggaaaacagaccatgaaggtcttctctatttattcaccagttaagcaccaaaaaggaactaacgaaaccactaaagccgatgcaattaagcaggagggccctctggaagggactggtgaataa

SEQ ID NO: 210 - DNA, 753 bp, Lactobacillus plantarum
gtgaattcatctgtgcctggtcaatatcaaattacgtataagtacggtccagacaatgtttcaaagacaattacagtcacggttaaaggtggtagcacttccggcggtggtagtacgaatgataataacagctcaaccaatgggtcaaataacaactcaaatggtaatataaattcaggttcagataataattcaaatcaaacgaccaatcctggcgagaccactgataccaatggtagtactagtgtgacaccagaaatcggtaacggtcaggtagccgtcaaaggtgaatcggtttatgctacgaagaaaattggattatataagaaggctgattttaagcgtaataatcgagttaagttgtattcaaaggctaagcggattaaccgtcctcagttcattgtcaagggataccagcgggacaatgcaggtaaactgagatatcgcgttcaacaatataatccgtatacccgtaaatatgtaaagggaaccaaaggatatatcacagcgagcgctaaatatgtcattcctgtttattaccgctcaactcctaagagcaacaagataacagttatcaatcgtaaggggcttaattcttatcggaagacttttttaacgcaaaaggtcacccattataagaagggtgctttattaaaggtcaaaaaagtgattaaatataaattggcgacccgttatcagttgactaacggccactatatcacagccaacaagaagtttgtcattcagaaatag

SEQ ID NO: 211 - DNA, 495 bp, Lactobacillus plantarum
atgagttcagatgccagccacaccgttgagcaggctattcaaacactcaataaagctggattgccggtttggtcaaaaaccaccagcgttgggacaacgtatcgtggtcgtcaggaaaatgtgatcaatgttgtccaaactctttgccaattggctcataaagaaaacaccgagacggcttttgaactcaccttttctaaaggctgtcgcggtgataaggatgccgatcattttgctaatgaatccataaaaccattaacgattactgatctaccagacttcccagtccagtgcaaatatgctttctacgcctttggtgacgatgactatatgaatgaaattcaagaaatcgtcaacttggctgaaaaggtaggcttagagccaagcgaaattcactacgccaccactctgactggcaacattagtcaacttttcacctatttcaaccaggccttagcatattgcgcatcaacatattcaacactatgttattga

SEQ ID NO: 212 - DNA, 1323 bp, Lactobacillus plantarum
atgaagacaattgatgatattcgcaaattagctaaagatgaagaggttgaatacataagaatgaccttttctgacctgaacggtgctttgaaaaatgttgaaattccgatcagtttattagatgaagcacttgaaaataaaatcaaaattgacggatcttcaatcactggatttctaccgattcaaaattcagatatgtacctgcaccctgacttaaatacatggactatttatccctggatcaccacgggtgggaagacggccgcactgatttgtgatgtctacaatcgtgacggtaccccatttgctggtgatcctcgtttcgttttaaaacgactaaatcaatcattgaccgatattgattgtggccatctaaatgttggtgccgaaatggagtacttcctatttaaagcagatgaatctggcaaaccaactgacactttgaatgatcaggcttcttattttgatgtttatccagatgataatggtgaggcttgtcgccgagaaacggttaatacattgaaacaaatgggcttccagattgaagccgatcatcatgaggtcgcaccgggtcagtgcgaaattgattttcgatttgatgacgcggtctttacggctgatcgaattcaattgttgaaattagccaccaaggcgattgccgttaagtatggcctgcgggcaacctttatgccgaaaccaaaagctgggatgaatggttcggggatgcatttgaatacgtctttgtttaaggatggcaagaacctgtttgatgattccaagggtagccacggtctttcttcactggccctgaattatttagccggtattttagctcatgctcaagcctttaccgcgattaccaatccaaccattaatagtttcaagcgattagtcccgggatttgaagcgccaacctatgttgcttgggccgtggataaccggacagcattggttcgagtccctgatggtcgtggtccggcaacgcgtttcgaattacgaagtggcgatccctctgctaatccatacttggcaatttcggctttgctagcttctggattagatgggattcaacgtcaattaacgcccaataagaatgttgaagacagcatttataacatgacgccagaacaacggaccgatgccaaaattgttgaattgccaagctcattgccggctgcactggctaatttgaaaaatgatgatattttagctaaatctttgggaagtgttgtgccaaagtatctggaaattaagcaggatgagttgaccaactatcagatgagtgtcactgattgggaaaagaagacttattttaatgtttaa

SEQ ID NO: 213 - DNA, 309 bp, Lactobacillus plantarum
atgaaaaattatcccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagtccccggtgatttcccagaatggcggtcagcttacaactattacaaaatttggtcaactaaagctgagcctacggctgattctttattggaacaagttttaaaaaaattgtcattgctcggcgaacttaccaaggacgttcagctttaa

SEQ ID NO: 214 - DNA, 345 bp, Lactobacillus plantarum
atggtaagccaaggtgatatattttatgttaactttaatccaagccgtggtcatgaacagatgaataagcgaccagcgattgcgctaagcaatgatctagtctgtcagacaagtaacatgacgattgtggctccaattagcagtaccaagcgtaattttccaatgtatcatcgactaactagtagtcaaacagtatatggaaaagtattattagatcaaaccatagccttagatttacgggcaagacatgtcactgatgaaactattgtcgatcatgtatcgcgtgaagaactagaagaaataatcactttgtacaaattattgtttagtattgatgacaaatag

SEQ ID NO: 215 - DNA, 264 bp, Lactobacillus plantarum
atggaacttattaaagaacaaacacgcttagcaaagtggggaaactcgaaagctgctagaattcctagccaaattattaaacaactgaaattagatgataaccaagatatgacaataaccattgaaaatggatcaattgttttaacaccaataaaaaagaacccaaccaatattcacgaactatttaaggattggcaagatgacgggaaaagggatcacgagcttgattggggaaagtcagaaggtaatgaacttcaatggtaa

SEQ ID NO: 216 - DNA, 588 bp, Lactobacillus plantarum
atgcaacaagttgtcttacccataaaagattcaaacgttcttaaagaggttcaagatacgttactcaataactttaaagctggccgacgtaactatacgatttttcaagttggtaaagctacgctactgcgagtgagtgacgttatgggtttaaaacagaccgatatttttaatctggacggttctattaaacaaaatgcgttcattcatgatcgaaaaactggtaagcctaataccttgtaccttaaaccagttcaaacagaactcttattgtatcgtcaatggctgcttgatcataaactagcatctgaatggctctttccttccattcaacacccagatcgccatatcactgaaaaacagttctacaaaattatgagtagggttggcgatctgttaggaattaattatctaggtacccatacgatgcgcaaaaccggggcttatcgtgtttacacgcaatcaaattacaatattggcctagtaatgcacttactaaatcactcaagtgaatcaatgactttagcttatttgggcttggatcaagcaagtacagaaaacatgttgaaccaaattgattttggataa

SEQ ID NO: 217 - DNA, 273 bp, Lactobacillus plantarum
atggagttgctagaaaagcaattggttgaaaaggataagcagatcgaaaagcttcagcaatctttgggcgaagcccacaagttacttgatcagcaacagcaattaaacttatccactaaccgtcaaaatgaaaagctactcgatgccccacaaaagaccagcgaggacgcctcaaaggacgatacagacgttttagaacccactggggatcattacaagggggaagaaactaaaacgcttaaaaaaggcttattcggctggttgagacgttaa

SEQ ID NO: 218 - DNA, 243 bp, Lactobacillus plantarum
atggactttacagatgtttatggcattaagcatgaaaactgtacgttgattacaccaactgaagaatatcgtcggataatcatatttatggattcagttgggcgtcgatttgttgcgattagtcctaatcctgaaccaactaagtatggttctgcaaaaagtcattggaagcaaggaaagccgaatggcgcacccaaagaatattttcatatcgacaaaaaaactgctaaccaatatggttaa

SEQ ID NO: 219 - DNA, 201 bp, Lactobacillus plantarum
atgcaaagtggtactgtgaaatggtttaacgcggataagggctttggatttatcaccggttcggataataaagatgtattcgttcatttctcatcaatccaaacagatgggtttaaaagccttgatgaaggtcaaaaggtaagctatgaagttgaacaaggggatcgtggccctcaagcaacgaatgttgttccacaataa

SEQ ID NO: 220 - DNA, 369 bp, Lactobacillus plantarum
atgcgtcaagatgttaagaagatttgtaatttattaaaacaatatgccaaactaaaacgtgacttgacaacttttaaccaagtttctagtccctcattcgatggagtatccagtcatagtagcctaaacggcactgaaagccgcctggtaaaccatgttgacttatcttaccagttaaaagaagtcgaagacgccctcaatacaattgatgatccgcaatatcaatttatcctacatgattatattattgagaaacgtttcaaccgcaacgaagcctgtaatcaattatcggttagtgtcagcaagtttaactacttaaagaaccgggcacttgaagtgtttaaattaaactatcttcgaactctgtga

SEQ ID NO: 221 - DNA, 213 bp, Lactobacillus plantarum
atgttaggagtcattaagattgacgaaaagaaagtattaaaaccaattgatgaaatgcttgctgatccttggcaagttgatattcaagaattgtttgaagcttctgtcaatgaacctgacgagattaaaaagaatttgtatgattccttatacacttatattttgcaaaaaagacaagaagatattattaatcgtcctggcttcgttatttag

SEQ ID NO: 222 - DNA, 204 bp, Lactobacillus plantarum
atgaaaaataccattgccactcggcggaaacagcggaaattgtcacaagccgaattggcccaactgaccgctgttacgcgacaaacaattaatgcgattgaaaacaataagtatgatccgtcactatccctcgcattcaagttagccgccattttagagaccacggtcgatgaattattcagtaatggggaggatgtcaaatga

SEQ ID NO: 223 - DNA, 435 bp, Lactobacillus plantarum
atgagtcgtgctaaaaggattcttcggtttacattttgggtgaacaacctagtatttttgttgctagctgcactgattattgtcagtttcagtcatctgttttatatctgggcaccgattatatcgctcgtgttggtggtcacctgtgtcgcgatgctctggtacatgcggcaccaactcggcgtcaagtcatttaaaggcctttactgggttgatgacgaacgtgatcggctgattactcttaaagttcattccacagttatggtcagtgccacttattttctatacggattgctcggcattatctgcttactgttgaattggcgcctctcgtctcaggaactgggacaaacgctcctagcaatcatttggctagccctagttgccagcaatctacaatactattggctatggatcaagtacgatcaggaataa

SEQ ID NO: 224 - DNA, 588 bp, Lactobacillus plantarum
atgcaacaagttgtcttacccatcaaagattcaaatgttctcaaggaggttcaagataccttactcaacaactttaaagctggccggcgtaactatacagtttttcaagttggcaaagcgacactgctgcgagtcagtgatgtcatgcgcttaaaacaggccgatatttttaatccggacggttctattaaacaaaatgcgtttattcatgaccgaaaaactggtaaacctaataccttgtaccttaaacctgttcaaacagagctcttattgtaccgtcaatggctgcttgatcataagctggattctgaatggctctttccttcaattcaacacccagaacgccatattactgaaaaacagttctacaaaattatgagtaaggttggcgatctgttaggaattaattatctagggacccatacgatgcgcaaaaccggggcttatcgcgtttatacgcaatccaattacaatattggcttagtcatgcacttattaaatcattcaagtgaagccatgactctagcttatttaggcttagaccaagcaagtaccgaaagtatgttagatcaaattgattttggttaa

SEQ ID NO: 225 - DNA, 279 bp, Lactobacillus plantarum
atgacattagcactaacacagagcgattttcgcgctaacctaaaaaaatatttagatcaagttaatgacgaagacgaaaccgtttatattgctcgttcaaatagtcgcgcagtagccatcgtttcacaagaaaaaatggactggctagaaagagcattaaaagctaaagaaggttcgttagaatatgcaattgcacgtgatcagttaattaaacgccatgttttacctgacgatgaaattgttgaatcagatgatgattattggggtcagtttaaataa

SEQ ID NO: 226 - DNA, 357 bp, Lactobacillus plantarum
atgaaaaaactaagatttaaaccacgtgcaacctttaatgctgatctaaaacggttagccagtttagacaaatctattattgatgaagttcgagcagccattgacctgttgcttgagcaacaacaattaccatcagaatttgaagatcatgagcttaatcggcgaatgagcggttataatgaatttcacttacgagataccccgaaaaacaaaacaccaagcgaaactaacgatgtcctggtggtttatacgattgataaagatgaactagtcttaattggcattcgagtcggatcgcatgatcgtttatttcctggtcaaaatcgtgctaaaaggtatcgaaaaaatgacaaatag

SEQ ID NO: 227 - DNA, 213 bp, Lactobacillus plantarum
atgaaattaaaagtttggtggctaagcaatcttatttggctaatcatcttcagtatattaagctttgtaattttcattagaaaagttgctggtgctggaacgattcaaacgccagcaactaaattagctgcttttattgtgctagtggttttctttattgttatcatcttgatccaacttgtcttactgctatttgttaagcatagaaagtaa

SEQ ID NO: 228 - DNA, 323 bp, Lactobacillus plantarum
ttgagtaagtttgcgattaaaaatcattggatagaagttgtcttggttgttttactagttggggttacaattttaagtattgggtggcatatttatcggtatggtggtgattattactacatgcgagtgaatggtagtagtgaatcatttcctgtaacagttccagttgggattacacagaacggctatgtttatcgtggtattgctaaagataagtatgggaatcggcaacggctagaggttcaaacggttgctgatgatttagggccatttcataagggacagatcattagaattacatataatcctaaatttggtgtgac

SEQ ID NO: 229 - DNA, 1176 bp, Lactobacillus plantarum
atgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctgggaacgttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaacctgattgagaactttaataagcatctcaagcgcaccacccaccacaaagaacaatttccaacggaagattcactggatcgcttcctggtttctcagtttaatgtttataacgagaagtctctgaagcggatccaccgagggttccaaggactccaggacaccttggaagcatcatttatttaa

SEQ ID NO: 230 - DNA, 1740 bp, Lactobacillus plantarum
atgtgttgcttcaattcattttctgaaaggtttgtggttcgaattatgtttaaaaatgtaaggaaaaataaaaggaatatttgggaattattcggcattatagtaagtttcggattaatcacgatccttttttcgtattccttatggagcacaaaaaaatatcctgttattattagttctgactttttctttcacatgaataggttgaagagctttttggtttcagttcaacatcaacagtattttccaaggattgcagtaacttttttgaattataacggctatgcttcacctatgttttatagcaatttaatattttatccgttaattttttgggctaagttcagcttttcgtacttaactttgtacaagatactgataatgattaccactttttcggggctagttatcacgtatgtgtgtgcgtggacttttaccaaaaaacaactacttgcatacttaattgcaattttatacatgacatcgattttttatcaatatgagttactggtgagaaatgcgttaggtgaaggggttgctatgatctttttgccaatagttttattgggtatgtatcgattagtgaatgcaagtaatcatggatggttatgtttgtgtctaggaatgacattgcttgtttatacgcacttaatcactacggtaatgtgtggcataatgttacttttttatttgatttttaatgtgaaaaaagttcttcaaaataaattaattttagtaaatctaattaaagctagcgttgtgagctttttgttatcagcaacatttcttttgcccatgcttgaacaacttaagcgagtgccaatgttcatcaatgcatcagaaattggaaatattaatcattttattaagtcaccttttgatctgttttcaggtacgtttgcaaattctcttgaatcgacaaatttgggtattatttttacgttagtcgtgggaattagaattattatgtgccataagcaaaaatggcttatatatggtgatcgttttatcatattgggaataattattgctatcagctctacaaatgttttgccttgggagcaattacttgattatacgaaacttgcatttttacaatacccattgagattaaatgtatttgcaacgttactgttagcaattggaagcgggatgtatatatacggtgaacttcaatgctataaaagtaaggggagacgattagagatatataaaatactggctatagtactcatcttatttatggatttttcagtaattttttcaatcacgtcaccaactagaaaatcatatgaaaaatttgttaatagtcaaacagctattgattcaatgcaaattggaaatggtaaggaatatttaccggttggtaccaaacagcaatttttgtcaaacgatgtgaaagcattacgtggtcggacgacaagagttagtagaaagttgaatgagtttaaaataagataccaattatcaaaaacttcaaatgaaggtaagctggttgtgccattattgatgtatccagggtatgcagcgactgaaaacaagcatgaattaaagataagacaaactaagaatcatcaaatttgtgtttatccaaaacgctcaggaataattcacatttggtatagaggaacggatgttcaaaaatatgcaagcttagtgtcaatttcaacattaataattttagttatttttcaatttttttcctttataaggagacaaacacatctcaaaacaacctaa

SEQ ID NO: 231 - DNA, 132 bp, Lactobacillus plantarum
atgcctaaaacaattaaggaacttgctgacgaatttgatgtatcaaaacaagccattaggaaaaaactcgatgaaaactttagagaaaaatatgtacaaaccgtgactaggaacggtttgtacaaacgttag

SEQ ID NO: 232 - DNA, 936 bp, Lactobacillus plantarum
atgagcaatgaattagtcaaatatgaccctgaattaaatacaatccccttgcgaaggtttactcctgtagaaatgaacttgttcttttctgtagtttctagaatgcgtgataaaggtgatgatactgttagatttacctttgatcagttaaaagagttaagtgcctataagccaaccgcaaataatcggtttattgatgacgtacaaagtacatatcaaaaaatactaggtcttagatttggctctcgaagtaaagatggtcttgatagagagatgtttgtcatgttcactcgatttgaaattaagggatctgcagacgttccttatgttgatattcaaatttatcccaaagcgttgaaacttctaaataatctcgaaagttgggttcgttatgcgttgacagagttccgagatttaaagagtagttacgcaaaaacaacttttcgtattcttaaacaattccgaaccactggttatgcttatttttctaaaaatgatttctttgaactactagatattccacaaagctattggagtaagcctgcgaacgttgaatctagggttattcgcccaattaaggaagaactaacccctttgtttagaggcctaactatacgaaaaaaatatggtaaaggtcgtgggaaaccagtgattgggtattcttttacctggaagcctgaaagaaaagacgcaaacgacttttctcaaggtaagttccaagatgagcgtcaaaaactttttaatatccagaataatggtgaattaacagaacaagaaaaatggcgtgctaccgataaagttaaaggcctaccactaggctcaactgaaaaacagattttagccgaacgacagattgagcatgataaaacaataagagatcagacaagacaagaaatgcttgctgaactccaaaaggggtttggaaacaatgcctaa

SEQ ID NO: 233 - DNA, 183 bp, Lactobacillus plantarum
atggatgaacaaccagaaatcgtgcaagtgaaagtcggtcggacaacagaagccccagcttctggacccgtcaaagcgctacaaatcaaagttgatggcaataaatcagttattgtttacaaccatgtcaacgggtatatcctcgatgccgtcatgaaggcggtgttcccacatgatcattga

SEQ ID NO: 234 - DNA, 348 bp, Lactobacillus plantarum
atgatcattgataccagcaaaatcgaacaaatctacctagtttgtggtaagactgatttgcgaaaaggtatcgatggactcgcgggtatcgtccaggagcagtacgatttggatccatactcgcaagcactgtatctcttttgtggtacacgcaaagaccgcttcaaagccctctattgggatggcgacggcttcttactattatataaacggttagaaaatggccatctacaatggccgaccaatcaacttgcaattcgcagattggacccgcgtcagcttgttcgcttattgagtggttgggcgttagattcgacagttcataaagtctgccctccaggacattga

SEQ ID NO: 235 - DNA, 927 bp, Lactobacillus plantarum
atggcagaatcagaaaaggatcaaatcattcgcaagctcaaagcagaaaataaggggcttcaggaacagattgcctatcttaggcgaaaactatttgatcataaatccgaagtattaaatcctaatcaaacgtcactatttgagaaagaaaatagtgtttttaacgaaccagagcaaactggagaccaaagcagctccgcgtcaaatcaagtacggccaaagaaatcaaagaaaaagacgcggcgagaaaaagtagattcaaaggtcccagtacgcgtaaccatcattaaaacagctgatggtaaatgtccagcaggacattcaggcatcaagccgattgggacaagatacgtccgagaagaatttcatttcattcctgcccgtgcatatctggagaaaatctacgagcaaacttataagtgtgaacaatgtgctcatgatacggcaacatctggtttgttcaagccattggtgccaccggccttgttcccacatagtttggcttcggtctccctagtggcagaaattatacatgataaatttgtcttgggggtaccgctatatcggcaactatctgggattcgtcgtttaggttatcagacatcagaagctaccttggctaattgggttaacaaatctgctcaacagctattacccctctatgaggaaattcattggcacttgtgctcggctcatcacctgcaaggtgatgaaactccaatcgaagttctgagagaacctggtaaagccgcgacatcaaggtcttacatgtgggtggcgcgaacaccaatcaaacaaccaaatcccattgtctattatgcttatggtaccacacgttctggtgtctttgcccaatccttgtatgaaggatatctaggcgttttacaatgtgatgggtatagtggggtacaacctacttggaaatag

SEQ ID NO: 236 - DNA, 657 bp, Lactobacillus plantarum
atgggtatagtggggtacaacctacttggaaatagcgttcaccgcacaggttgttgggctcatgttcggcgtaagttctatgatgcatctcagtcacatatcaagggagctgacaatctgcttcacttgattgacgagatgttcgccctagaacgggaatggcaagcctattcaccacgagtacgtcgtcggcgacgtcgtagtcgcttgagaaaagttctcaaacgcttttggcgtctgattgatcgtaccgaggtcttaccacagtctcgtctaggcaaggccatcgtctatgctcaaaagcagcggccgtatctcgaccggattatcaatgatggtgccattgattggagcaataatgcggctgagcgtaacatgaagagtctggtgattgggcgaaaaaactggttgttcagcacaagtacgcaaggcgctgaagcaaccgctatttggatgacgtttattgaaagcgccaaggccaatcatatagatccgcgtcaatatttgacggatttattaaaagcttcaacgattctgccagcatttccaaaatcggaagagttggaggcttatttgccatggaattatcgaagacagcaaaatatgggccaacggaaagacaataatgaggcccaggcgacgacgttcgccgcataa

SEQ ID NO: 237 - DNA, 1350 bp, Lactobacillus plantarum
atggataaatttaaaaatattattattggatttggtaaggcgggtaagacattagctaagtacttggcgcagcatgatgagaccgtgcttctgattgaacggtctaaacaaatgtacggaggaacttgcatcaatgttggctgcctaccatctaaaaatttaattcttaatggccaacgtggcgtggacttcactacagcagttaataagcgtggtgagatgactagacagttgcgaaacaaaaactatcacatggtggctgatgagccactagcaacggtttgggatgggtcagcccgttttatcgacaattatgttttggcagtcgtaatgagtgatggaacgactaagaaggtgagaggtgaacgtatctttattaatactggagcagttccaaattggccatcaatcccagggttagaatttagtcagcggatttttacgtctaaagaagctatggaattggagaaacaaccgaaacgactagcaattattggtggcggttatattggccttgaatttgctggaatgtttaattcctttggtacgcatgtaacgattttcgaccaacataccagattgttagagcgcgaagatcctgatattgcgaccgaggtcgtagcagatctgactgacgcagggatcgagattaaaccggcgactcaactaactcaagtaaaagataatggtgagaaggttacattatattatcaacaaggtgatcaaaccaacactgcggaatttgatgcggtattagttgcagtcggtcgacggcctaatataaatagtttagggctagaaaataccgatattgctttaaccagtcgtggtgctattcaggtcgatgatcatttaaggaccacagtacaaaacgtttgggctttgggcgacgttaatggcggtcctatgttcacttatgtctcattggatgattttcgtattattgtagatcaattgtttgataagggggatcgctcaacggccgatcgaatggtgataccgactgcttcgttcctaaatccaccactggctagcgtcggcttaaatgaacgtcaagctaagagtgcaggttatgatttacaaaccttcaagctatcagtcaaggcgattccaaaggcccgtgtcttggaggatcaacgcgggctttataaggtaatcgttgatcaaaaaacacaccttattttaggggcaacattgtatgccgctgaggctcatgaagccatcaatctaattgcattggcaatgaaggccaaattaccttacgaaagattacgcgacatgatctatactcatccaacaatgtctgaagccttgaatgatctttttaagaccccggttgtgaaaagctaa

SEQ ID NO: 238 - DNA, 180 bp, Lactobacillus plantarum
ttgcaacaacaagttcagcaagcaaggaacccacaacaaaaatcagaactaaaaaataaactaaatgatatacaccatgaaatcagtaatcgaacacaaaaacagctgcaagcatttactgaagaaaattcatcaatcaaacaacccaaatccgaatttgatcaaagtttaaagcgttag

SEQ ID NO: 239 - DNA, 1242 bp, Lactobacillus plantarum
ttgaaaacaaatcgctatgttgttgcgtttgcaggtgtcatgtttcatttaatgattggttccgtttatgcttggagtgtttttactaatccaattgcaaaacaaaatggttgggcagaatcctcagtcgctcttgcatttagtatcgctattttcttcttgggaatgtcagccgcctttatgggcaaagtcgttgaaaaaataggccctagactaacgggaactattgctagctttctttacggaactggaaccattatgactggttgggctatccatcaaaattcaatttggctattatatctctcatatggtgtcataggcggcttaggactaggagcaggatacgttacccctgtatcaacaattattaaatggtttccagacaaacgcggtttagcaacggggttagctattatgggatttggttttgcagcaatgctgactggtcctgttgctcaacagctaatggctagtgttggtcttgaacaaacattctatctcttaggaacattttattttgttattatgctgctcgctgcacagtttattgttcgtccaaatctggcactatcaagcactactgaaaatagcatttctcaaaaaaagggaacacgtctaacccgaggaccggagctaacagctaaccaagccctcaaaactaaatccttcacttttctttggataatgttctttatcaatattacatgcgggatcggccttgtctcagctgcatcccccatggctcaaagtatgaccggcatgtctgtccaaacagccgcaattatggttggaatcataggccttttcaatggctttggacgtttgatatgggcaactttgtctgattatatcgggcgccctgctactttcagtgccatttttattctcaatattgtaatgctttcagccatgctcatcttcaaattaccgctcctatttgtcattgcattatgcttgttgatgtcttgttatggagcaggcttttctgtcatcccagcctacttaggtgatgtctttggtactaaagaattaggagctgttcatggatatgtactgacagcatgggctgctgccggagttgttggaccattactattatcattaacacatcaactgttccacaattatactttgacattagctgcctttattttgattgatctattggcactgctaatctcattctggatacaacgagatttcattaaagccagcaaattaataaaaagcaaatcataa

SEQ ID NO: 240 - DNA, 177 bp, Lactobacillus plantarum
gtgaaacataataagaagaaattacgtaagttagtaaacaagaacgaaatcgatcaacttcgtgaagaattgacgaaaaagaatcaagaattatatgatgcaaaattggagaacgaaatcttaaaaaaatcaatgaccctgttcggaacctcaaaggacgaaagaaaacacaaatag

SEQ ID NO: 241 - DNA, 2268 bp, Lactobacillus plantarum
atgactgatttatttgcagatgggactatctctatccatggagctcaagaaaataacttaaaggatgtcagtttagatattcctaagcataaaacgactgtatttgctggtctttctgggtctggtaaatcctctttagtttttgatacattagccgctgtttcccgacgtgaattgaatgaaacttttcctagtttcacccaacaatatttgcctaaatacggtcaacctgaagtgaaccgaatcgacaacttaccagtggcaattgtggttgaacagaagcctattggtcgtaattctcgatctactctggcgacctacaccggcatctattccgtcttacgtttgatgttttctcgaattggacagccttgggttgggtattctgaatggttttcctttaacctacctcagggaatgtgtccaaaatgtcagggattaggctttgttgacgacatagatgaacgtcaattaattgatcctaataaatcactcaatgaaggtgcaatgacttttgccggttttcaaccgggaacttggcgttggaaggaatatggcaacagtggattatttgatttagacaaaaaaattaaagactacaccgatgaagaatatgatttattcatgcacgctccgcaacaaaaattaaaaaatccaccggcaaattggggccgtacggcattatatgaaggactagttccacgtatgcttcgctctgttattcatagtgcctcaggtcgtcatcatgaagctgccttatcaaagattgtcactcgaaaaccttgcccagtatgtcatggaacacgtctgaacaaaaaggctctaactggtaaaattgctggcaaaaatattgcagaagtcagcgatatggatttagtaagtgtcctaaaatttttggataatatctcggaccccaaggctaaaacaatggtgcgtgaactacgtagtaaaattcaagctttggtcgacatcggtttaggttatctttcccttggccgtggaactgatactctatctggtggagaagctcaacgaattaaaattgccaaatatttgacgagttccctatccgatttagtttacgtactcgatgaaccaagtgtaggactccatcctcacgatattaaattaattacccaatccttaaaaaagctcaaggaacatggcaataccattatcctagttgatcacaaccctgccattatttcgacagcagattatgtcgtggaaatgggaccacaagccggcaaaaatggtggtcaagtaactttcactggtacctacgacgaactattacggtcagatacgattacgggtaaaatgttacgagaaaaaatcactttcccaaagcctcgtgaacctcaatcttggctaaatgttaatcatgtaacttctcataatttaaaagacgtatctaccagaatccctcaaggtgtaatgaccgtgatatctggaccagcaggttctggaaaaagtactttagtccaagctttcaaacaacaagtttctgatcaagactatattgatttgagtcaggattctgtaggtttgaatattcgttctacacctgcaacttacttgaacattttaaatcctctacgaaagcttttcagtaaagccaacaatggcgtttcaacacaactatttagttataacggtaaaggtgcttgtccccgttgcaaaggtaaaggtgtgatgatcaccgagatggcattcatggatccaatcgttcaagaatgtgagttgtgtcatgggaaacgttatagccaagaagcactacaatacacttatcatggcaaagatatttctgaggttctaaatctttctatcaacgacactttagagtttttcaaagatgtgccagatatctacaaaaaggttagtctactccaccaagttggacttggttatttgaatcttagccagtcgatgaccactttatctggtggtgaagtgcaacgtgttaagttagcaatggaattgaatcataccggccgaatctatttcttagatgaaccaacaaccggattgcacttacaggatactcaacaattgatcgatttatttgaaggattggttgataagggcaatacattaattctgattgaacataatctgaaattaatttcacgagccgattggttagtcgatatgggacccgatgctggtaaattcggcggtcaagtttgttttgaaggtcatccaaaagatagcctaaacgataaaaactctcggactggtgctgcattagcagctataatttcttaa

SEQ ID NO: 242 - DNA, 606 bp, Lactobacillus plantarum
atggctaaaatcggttatgcgcgtgtgagttccaaggagcaacatttagatcgacagttagcggctttaaaagacgttgataaattatttacggataaattaagtggggctaacactaatcggccagaactgcaaaaaatgctggcctatattcgtgagggtgatattgtaatggtcactgaattagatcgcttaggcagaaacaaccaggacttaactaagattatgaacaccattcagaacaaaggtgccaccctagatgtgttgaatttgccgtccatgacggggattacggatcctaacttgcgtcaactgatgactaacttaatcattgaactgtataagtatcaggccgaaagtgaacgtaaacgaattattgaacgtcaacaacaaggcattgccctcgctaaacagcagggcaaataccatggccgtaaagcacaatataaccaagatgatccccgcttacaacatgcctttaaactatatcaagccggtatgagtgatgtggacgtggcccgcaataccggtataaagcggacaacttttattcgttatcgaaagaaatttaagattgtgagaggtggagtacatgaagccacataa

SEQ ID NO: 243 - DNA, 324 bp, Lactobacillus plantarum
ttgattaaatacactaaggcggccaaacgggctaagtcccacgttgagtgtgatacgattttgatagatcaagacagtgccagcgatactttcccggttaacgacatcgaaacgagcgacggtacgattgaacacgaggctcacgtttcgaaaatctctgaagcccaactgtactacttgaaaagtcggggattagacgaagcgaccgcctcccaattgattattatgggatttttggagcccttcactaagcaattgcccatggaatacgccgtggaattagaccggttgattaagtttcagatggagggcagcatcggctaa

SEQ ID NO: 244 - DNA, 624 bp, Lactobacillus plantarum
atgcatttagttcaagcatttttactttcattcaccgcattttttgcaattatgaacccctttgctaacttgccaatgttcgtcagtttgactgctgataacagtcgcaaggaaatcaacgcgattgcccgactggcttttatcgtggcgaccgtcatcgtggtactgtttgcctttctcggaaattacatcttcaccatttttggtatcaaccttgctgcactccgcatcatgggcggaatcattttggggttgattggttaccacatgatccaaggtaacgtttcgccgatccagcacgataccgaaaaatccgttaaggattccgtcaacagtagtaacaccaacgtcgcgatttctccgctagccatgccaattttggccggccccggaaccattgccaccaccatgaacttggctagtggaactaaccccttcatcgtcgtggccgcgttcgttgttttagcagtcattgcttacttcatttttatctacggtgaacaaatcatggacaagctgggcaacaacatcatgaacgtgatcaccaagttaatggggctgattttagcaaccatcggcgtcaaaatgctgatcgtgggtgtacaagccgccttccacctttaa

SEQ ID NO: 245 - DNA, 792 bp, Lactobacillus plantarum
atgatgatgaattcaaaaaatctttcattggcctttaaagaaaacataaacagtcaagggatgttgaaaatagctaattatttaaaagaattggggaaaaagagcatgaagtattttttgacaagtaatccattgttagctaaagagcaaatactaaatcctagtaacgaatttgtgaataatttacaaaaagatatacctgagagggctaatgcactattcatatgttcggaccctaattcgtatgacttgactgataaatttgcagaagaaatgaagacttgtttctttaactcaggttttaaatttaagaattttaaagtattagataatagaaatgcaaaagaaaaaagtgagttaataagcgaagcagaagttgtcatacttgcaggaggacatgttccaacacaaaatatattttttcaacaaattaatttaaagaatgagttaaaaactgcaaataagattattatcggttttagtgcaggttcaatgaattgctcggaagaagtttatgctcaaccagaactacaaggagaatctttagacccaaactacaagagatttttaaaaggtttgggaataacaaaatcacagattttgcctcattataatttaatcaaaaacgaatatttagatggtaagagactttttgaagaaatcacttatccagatagttttggcagatcatttattacattaaatgatggatgttatttatatggtgatggtcaatatgaaatagtttatggagaaagtttcattatttctgatggaactattaaaaagtaa

SEQ ID NO: 246 - DNA, 450 bp, Lactobacillus plantarum
atgtcattaaagcttggttggttggagcagtacgaaccgatatacctcttttggagtggagtaattctggcggtactgttaattatttttttgcttatcacacttttttggccacggtcacaatcattatatcttcatcaaaagtctgatggtcaagtgaccgtcagtaagaaagctattgaacattttgcgctttcagcacttcaacatgaaccctttattggcaaccccaaggtatcagctaagttatcacgaaaaaggatcacacttaaaatatcgggtgatctactaaattcagtcaatgccaagaaacagactgcaaattttcttaatcaattaaaaaaagatttgcgtatttgtcttggaatttctgaacagaaaaaaattaaaatcagactcgttgattttaatgagttggacgctaatgtgcaacaatctcgagttgtctag

SEQ ID NO: 247 - DNA, 186 bp, Lactobacillus plantarum
gtgaccgaactcattaaagcctatttttggccactaattggtggaattatgggattgctcttagcggtccttatcatcacttttggatttttcaagacgctttttgttttgatttttatggcaatcgggattaccgcgggttattatattcaaaaaactggtatcttaacaaatgtttttaaataa

SEQ ID NO: 248 - DNA, 543 bp, Lactobacillus plantarum
atgcagaatggaacgccaagtgagaaaacaacaactaacgaaaagtctggtgttaaaggcaatttaacatttgatgataaggttattcaaaagatcattggtatcgcactttctgaagtagatggcttattaaccgtagatggcggctttttctcaaatgttgctgaaaaactagttaatacttcagatgtcacatcaggaattgatgtagaggttggaaaaaagcaggttgcagtggatctcgacattgttgctgaatacggcattgatatttctaaactgtatgacaagatcaaaaatgttatcgttcgggaagtaaagaatatgaccgaattagaagtaattgaggtaaatgtgaatgttgttgatgtcaagacaaaggagcaatatgaaaaagattcgacttctctgcaagatcgcgtgagcgatgccacagacaaaacgaaggaagccgtcagtaagggcgcaaagaaatcgaaggaaacattaggtgacagcgttgataaagtaacgtctgacaataaatctagtcgtgttaactaa

SEQ ID NO: 249 - DNA, 252 bp, Lactobacillus plantarum
atgggacttatttggtcattaatcgtcggggcaatcattggtgccattgctggcgcaatcactaaccgtggtgctgctatgggctggattgcaaacatcgtagctggtttaatcggtgcgtggattggccaagggctccttggcacttggggcccttcgttagctggcatggcattgataccatcgatcatcggggcaattattttagttctgattgtttcattagttgttggtcgaaccagtaaaaagtaa

SEQ ID NO: 250 - DNA, 141 bp, Lactobacillus plantarum
atggacgtcttgaaaagtgtatttaagtttatgatcgcttctacgctcattgtaggtggtgtcctcatcggtggcaccgtcttggctgctaagaaagtagatggcattggtgatacattgcaacacaaattacatggataa

SEQ ID NO: 251 - DNA, 198 bp, Lactobacillus plantarum
ttggccaagacacgaacatatatggacaagtataaattcacagctgcagaaaaccaacggtttgcccgagcaaattttaccaagttagtgcatactaatgctcgctttgaaggcgttaataccactttgccacaaacacaaactattatggacggtatgagcgtagcaggagtacctgttgaagatgttttgacgtaa

SEQ ID NO: 252 - DNA, 198 bp, Lactobacillus plantarum
atgatcaaaccaagcaaagaagtcgaaaaaatagagcaattgctggctgacccctgggccgttgatattcaaggcatttgggaacaagcagcccataacccagatcctgataaacgcaagctgtttgacgcgttacacacttacctcttagataaacgccaagagcaaattatcaacgaaaagcattttgtgatttaa

SEQ ID NO: 253 - DNA, 408 bp, Lactobacillus plantarum
gtgaaccatgctaatgacttcttaactgatgaagacagtggcttaccggttttcttagaaccagaagccgtgcaattacttagcttctggtgccgaactccgcaacaaatgcatcgttttattggcattatcttaaatgctaaataccgagttgaaaaggatcatcaagatattggcgtcataatccctcttgacgacgaagaactaaaacctttgatgactaaagccttaagacgctactttaacgccctaagaagcaatgagaagcatatcaagaacgtggagaactacttatacggcaccatgcaaaacctatttgggatttggtggaataaaaaagcggttagaaaatatgcggctaaacaccccgaagaacagaacactgacaatgagcgttcttggaattaa

SEQ ID NO: 254 - DNA, 597 bp, Lactobacillus plantarum
atgacaaaatcaacaaatttcaattactatgaagccgataacgtatatggagccttatttttccagttccctaaggtattaatgtatggcgagcaatacaagcatttaagcagtgacgctaaattggcttatatggtactgaaagatcggctcgagtattctttgcgcaaccactgggttgatgaagataatcatgtttactttatttttaccgttcaagaattacagggcttatttaactgcgctactgaaaaagccgttaaaattaaaaaagaattacaaacagccaatctattaaaacaaattcaaatgggatttaatcctaaaacgaaaaagaatgaaccgaatcgtttatacctttccaagctcgatgtgaaagcaactgatgtctatttaaggggcgaatatggacaagaaacgccgaaatcccttgctacgagcggaatttcgaaaatcgaaagcaatctatataaagactctaaaaacatagatactaatggatacaatatagatactcaaaagttggacttttccacagccaatttctcaccagcagaaaaccagcagaaattcgaaaaaaatcgaaagtccgcatga

SEQ ID NO: 255 - DNA, 249 bp, Lactobacillus plantarum
atgagtttagattcattcaaccataaaaaagacgaagaaatgagagaaagttacgagactacgttgaaagacaacaagaaagatgcagtcgcatttttgaaaaatatcagtcgaaaggaagtagagcgtaagcgatcagtgaccttctcaattactgaaagtcaacttaaaaaaatggatgcggctgcccgaaaaaacggatttaaaaatcgttcagaattcttatcttcaatcatagatgcaatttag

SEQ ID NO: 256 - DNA, 807 bp, Lactobacillus plantarum
atgaagattgttacttttactgctatcaagggtggtgtcggtaaaacaaccttgactttgaattatggtgattggttagctaaaaatggtaagaaggttctattaatcgatttagaccatcagtgcaatttaacaaccgtttttgaaaagacacgacgaaacaataccatcgctgaagcattcaaagaagacgataatgctcaaaaagtaaaaattgacagtgtcggaccaaatctagatttaatcgccggttttatagacctagatgttttaggaagttatctagaaaataacagtaacaaagaaatgatgttgttcatgtggtttaaaaacaacttcgattcattaagcttaaccgactatgactatatcttaattgatacacacccagattttagcaccatcactaaaaatgctattgctatcagtaattaccttctcagtcccatcacacccagtgaacatggctacaatgctaagtttgatctagaaacacgactcgaaaaattcagaaaatcactttttgattatcgaactggcgaaacttacgtagacgcaaagcttttctttatcggcaatatgattagacataatacaagcatgtctcgcgatttgctcaaacacatagaaggcgatgaaacagtcgcgactataattcctgaaagagagctctttaataaagctactgcaaggcacgcttcaatatttgaattagccaatcatgatgaatccattttaaagcaaaatcaaaagttcatagaacacgccgatcatctttttcaagaattagcaaataaaaccaagtaa

SEQ ID NO: 257-259 - skipped (3 entries)

SEQ ID NO: 260 - protein, 402 aa, Lactobacillus plantarum
METTKSISGPGKSYVSKTRIGVLAVSSMGMAALAITPSYAAIASNFSLSNTSVQMLTSLPNLFMMLAGLIIGKLTATKLNLKTLTLSAAILVIIGGFLPLAFHTNFMFLLFCSCLVGLGQGACTNLSQVLISQMLPETERQSTMGLTTTFTNLGGIVFIMGGGQLAATNGWVNNYWIYLFSALILIVILTLVPMHPAAVNAANDQDTGEQIKLNKYVFFCAFWGFCTLLLNNVLNNNISLFVAEEKLGATSQAALTSTVSLIGGMLCGLIVGVIGKRFKYSSITISFILYGLSYLLIGLGHSLWLAFVGSFIVGAAMSIAMGQFPYLISISVGKNSVSMALGVYVAIYSIGGVVSPFIVNPLTKLVAGMSINVFVVSGVIALILGVLCMGFQFQKKLVTAAQ

SEQ ID NO: 261 - protein, 501 aa, Lactobacillus plantarum
MTNRTIDTDVLIAGTGGTGLAAAYAAVTHGLKVTVIEKQSQIGGNTKISSGFFAINSREQREAGMHLTTQEAITQLADYNHYLSNGTLLARIVNRSADTLAWLEKMGMEIKLNPTANTTQFAHRNNDYRGGSYHMYQHKDESYQRIQQTLTTAGVNFHFNTTFTDLVITNGAVTGATAMTASGDQLTITAHAVVVATGGYGGDREKVARTMHTTQLRTLGVPNNGEGLAAMVKAGGTDIDSHALIHAAQLAKSQVTQKTSQQHLAGFSGNPLTQLLLTPQLWVNMQGQRFTNEDVVYDTVEWANAAWSQGGQYLFIVDQATLNTFTTNRNREEVSQAGPGAATGSGDFTALAEEAVTGKTAFKGNSLTELATNAGMDPSTLSQTVATYNQAVASKNDSEFSKRLQSLDYSISDGPFYAFICQAAYLGTVGGVRVNRNLAVLDDDFKPIPGLYTGGANAGGYYEGHSYPAFEGLASGFTWTSGRIAGTSAAAYVKAKFATVN

SEQ ID NO: 262 - protein, 201 aa, Lactobacillus plantarum
MVHDLMNAGERTLRFIVYRQLRNQITQRYFDLLTELERQDLQDVFIDYQREMTVGLLMTELLRHHEERISITDSYFPGKNIRHVNADTQSGMIFTYLVAHNADATLKETACYFGYDKNYFSRLCRRLFNKSFSEQLTFIRIELAKRMLAFSNKRIEQIAAELGYKNNSSFFTAFKREVAITPNDYREQHGYRLAHQHINDN

SEQ ID NO: 263 - protein, 72 aa, Lactobacillus plantarum
MKARVVGNSTTLTIPKKFNVANGTEFEAEQLDDGSILFKLKHRNPFEGDWFNDQLEQSDITLDMEDVDSEWD

SEQ ID NO: 264 - protein, 121 aa, Lactobacillus plantarum
MNGTNQYIPRKGDIVLINFNPSAGREIQKYRPALVVSNQKYARLTKLALVCPITHTANNRMTALGLLIKIKTPKVDGYINPLQFHTFDYVRRDMRQVGAVDKQILDQTLQVINDVVNANEV

SEQ ID NO: 265 - protein, 53 aa, Lactobacillus plantarum
MDSLELCAGRATKQAMKRAAEELAKRKPARKTTKKAATKSHKTTKTKHGTSKV

SEQ ID NO: 266 - protein, 180 aa, Lactobacillus plantarum
MLVYNAFSAVRDGTFDQFKNYYSGNVDETDKFEGLNLLCMAMTNDDNPEEKLKIVHFLLQAGIDVNFVTKSEHRNALHYFYNCVWRPNPKFAMEITKLLVENGIDVNSVDKYGHVPLFYAVFDNDLDTKENEELYFYLLKAGSDYRLRDPFGKSIIDYARETNERTDFLDIVKEYENGKK

SEQ ID NO: 267 - protein, 87 aa, Lactobacillus plantarum
MATIIIIGVVIIGITLGLGYWSYLLGKRNQSNFVGPIIPVAYFAVRAILAVMTQTTTHGLVSSLLGSLLFSLIYYGLFVGGKHRANK

SEQ ID NO: 268 - protein, 350 aa, Lactobacillus plantarum
MRKKEIIFGLLSFIALGTVLAGCGSSSASSKDTSKTYKYGEVTIPAKDGSICNAPNYIAYEKGFFKKNGIKAKLVANPRDISDLEAGFASGKYDAQNGDFQYLPAIQNGAQIKAVGGIHQGCIKLLVPKNSSIKSVKDLKGKTIGIPAQGSTPQYVTSIALQHAGIDPKTGVTWKVYSTDLLAKAAEKGQVDAIGTVDPYAYQAQKESGFKTIIDNNNNSGNAKMAAMGMKSKGACCYLYVSSKLVKENPAKAKAIVRSYKQAAAWINNHPEETAKIELNKGYVSKTKFINVKNVTQILKDEHFELNLKTGKEDLSYYIKQLKQAGYLKKNTNNKQLLKQAYWYPDLSKN

SEQ ID NO: 269 - protein, 337 aa, Lactobacillus plantarum
MQITAVQLSRKKVVQAAKTTGRYWKPWHLTWNIVSLVVLAIAYFENQLVVSQETVNNQTYHWFLGGYFAYLLIVTLIGAVTNGRIRRYNGHFAQLNVSLVGLLIVQDLLTEKFVVLEQPFFVSFAQILDQMRENAGLLWASTLSSLALWLISFVIGTILGILLGLGMGRYREFNYWAFPYLKVIGIIPAAAWMPLTMVIFPTSYMAEVFLIAFSVWFPVAFMTIGGVQGISKEYFESAKTLGFSEWQIIRKIVLPGALPSIFTGVYTAMGLSFTMLVISEMIGAKVGLGWFINWAKGTGNYTQVYAAIVIMAILFSVLFAVFTKVQDYCLRWRDGAH

SEQ ID NO: 270 - protein, 256 aa, Lactobacillus plantarum
MGLLAVQHVNQRLQDNDGHQIDVLDDIDFTVNPGEFVAIIGPSGCGKTTLLRLISGLDHPASGQLTIDNQQIKRPDNSRGYVFQHGSLFPWSTIKENISVGLKVTRGRHYDHQLVDHYIELMGLKGFENAYPHQVSGGMAQRAALARSIIMNPQLLLLDEPMGALDAFTRADIQNVIEQVWQQTQTTMILVTHDIDEAVYLSDRIIVMTPRPGRIKEIVTNPLPHPRSRLSVDFAEFRHRIQDKLNFGAHDGQVTG

SEQ ID NO: 271 - protein, 315 aa, Lactobacillus plantarum
MGVRRAEIINGLRWSVVADALGLPAENRQRGTYPLITEMVASDFWKQPAGSWSDDTSMSLGLIENLVSGGDYDDLMSRFENYMRFGTNTPRGELFDIGRTCAHAIRNYAINQFPARQCGDPSVHANGNGALMYLAPLAVALQNDTSVAHRLTITRNYTMLTHGHARSVVASLIYLEVLHALHQGQALPAALVSVHELLISTIKDMTLLGELSTYGALFSPDFAQTKAGVIRTSGYVVDTLLAACWLALNYQTPREAVLAAVNFGGDTDTIATITAALTAAWHPDITVDTKWWQQTLNHKLLNAHFEVFTAKFASS

SEQ ID NO: 272 - protein, 336 aa, Lactobacillus plantarum
MTYSTDKPFTSLDAQLKMLKNRGMKIDNTDYARQVLLNNNYYSVINGYKDPFLRKDGAGEALKPEMFIHKTTFSDVYTLYGFDRDLRNIVLNYLLIFESRLKSIISYEFAQKFPDPYSYLNIVNYSNDIGDLSNVLKNLKNLSLKLNRGRNERYGKPSIIHYVQQHTHVPLWVLVNTLTFGEIQYLYDSLDQNLKEKVARDFSEYYKLHWKSSEKIDTGELKSLIIVANLFRNVCAHDERFYNYSLRTKIPKSLFSKYYMNNPMFDDLEKPVDLFALISLLALVLTRKQFKAMTYSINSLIEKSNYKLKSIGIGKVLDLMGFPEIQWREKIQVKSD

SEQ ID NO: 273 - protein, 734 aa, Lactobacillus plantarum
MSTADQLVLDTQQWLNSTYGDVAGFGSVPENGLTGWDTIYGLTRGLQYELGITDLVDNFGPTTAKLFDEIADDIVPGYSGNIAYIIQGGFWCKGIDSAAFDGEFTSDTVSAVTTMKEYAGLSDTSGTLDSQFMAALLNMSAFTLVADGYEKIRTMQQQLNHDYLAYTGILPCDGVYQRDTNTALIYALQAEEGLDTDTASGTYGPMTQELTPTVSTGDNNNLVRILQWGLYVNNQAYTGAFDGSYSLDVSSSVATFENDMALPETTGASAGLDVFMSLLTSAGNPDRDAVACETSHQIDASEAAALSSAGYKYIGRYLTGTAGTGSSEVDKNLTTSEISILTNAGLKIFPIYQDGASDDEDYFTQTKGSSDGRKAGLAAMQLGFPDDTIIYFAVDVDIQDGDIAGTVEPYFTGVASGISSFGFQVGIYATRNVANTIIVDGLAEKAFVSDMSTGFSGNLGFPMPSEWAFDQFNEVAFDDFYIDKVASNSSRSTAVDDFSAGSSVGGSDDLDAINEIIQKLGNTNTYFNFVKSVSVEAFSDTYTISTPAADFSLKVDLEGSISDDDGTVSATYKVNDGSTSFSVSDAVQELLTQNETALGSSDMTNAMNEIAGVIKNGDISSNTSIKTSLMTITLKIKSTFEHTASNGKTYSIEYEITLDIHFHEFIAPLPVNVTQTQATDYNNNLKTILSIPANALDYINNLHPDLQFTPTPASTESSLAVMMMFIITLLAAVA

SEQ ID NO: 274 - protein, 370 aa, Lactobacillus plantarum
MKYCPHCGNSVREKANFCPSCGNALVETSHAQSVSDSNNQFKEIYNNATAKLNHYTGEEGAVKVNIVALFSEVFKHHTKDEANSIFIAGTKTTTPALSDVSDEWAKPWLFSRILLGFLLAFVVLLYMVDGFSNSNAIPGLILVGAFAVPFSGLVFFFESNAFKDISLFEVVKVFFIGGIFSMVVTLFLYQFVTFSSTSQIFGVLTLKDSLSIGIVEELGKVLIISYFISQLDVHHVLDGILIGAAVGSGFAAFETAGYIYRANAQLVAVAILRGWSAVGGHLVWAAITGGAIMIVKRDHPFKFSQLLDTRFLVFFVLAVLMHAAWDWNITILGSNYLKLILLIGLAWIVVFVLMNAGLKEISHLKQQSHS

SEQ ID NO: 275 - protein, 983 aa, Lactobacillus plantarum
MRHLGKVPVWITYTVAFIILTCIIYSPLFLDGRSLIWTVDGISQHLPILTAFQKMLKGIGTQSLFGWSWNLGLGADQMTTFAYYVVGDPFNYLVALFPTTKIEFAYQFLILIRLYATGLAFLTFARIWHFSRLSLLIGSLTYTFTAFALHIGMHHPFFLLPLIFFPLLCWGIERVFRGKSWWPLAIVIAITVASNVYFAYVLALGSVIYTIWRYWQQYRQTKTYARFWQLIYHLLSAVLVGVACAAVLVIPTVLAMLHSTRTGGQFANGLSLYPLSYYIALPNLVLNSDGMPFWVILGISSLTWLAILHSLRHFKQRWDLNSLLIILLVGLLLPAVAATFNVLSSPSNRWLLLSTLLFSVLTMRLIDDWKKLDSWDYRLFLGASVGLIIIIWVVNGFTFNVSARDLISYILLFVLITWFIGSSAMHLSRLTLIIGCFTLLCLNLINTGFGATMTSSGVANPQQLYRGSATSWINKYLDGAQKALPRNDNFYRTTLTPGFYARGAASGKKNISMLLGTHDIASYFSVQNRSISQFSQSIGNQEADPNSPLSTADGRTTTRNLLGVRYIFELADRYDPKNIPVGYHALKNNDGHVRIFKDQPVAGGLSNKTGTIVFVNDNFLPLVSTQNAQISAAKYQRLNAVDKEQAMIQAPITDKPITGVKQVQPQKIATTVPYTVKVRNITDRPVNSSSRLSQKLVTTNKKIVNDNQTTNQDGLHQLVSDCQGHQLTYDLILDHPEKWQNKELYLEVSGMTMVKPTLNQFLQNNAANAVFANRPNTTLAKIQQFRQALHTDWQLSGYYLSASTAYRSNNFSQQSPTNLSNYSIRKRVILNLGYSSHLRRIVTVRFSQVPELKIHHVKLMAVGFKGRYQRQIKAIQKHGLKQQKVTNNTITGRTQAQTASVLTTSIPYSTGWHLTVDDKPTKTQVVNTGFVGAKIPAGQHKVKLQYHTPGLRLGAIISLIGLLLLLVSILWQSHAWLHNQSNQ

SEQ ID NO: 276 - protein, 287 aa, Lactobacillus plantarum
MRLGSIEAGGTKFILAITDEHYRILKRQRVATTKPNETLAACVSFFKKNPVDALGIGSFGPADIKVDSPTYGQILNTPKAGWSHTDVVQMLRAALKIPITFTTDVNASAYGEYMIGQGQAVRSLVYFTIGTGIGGGVIQDNHFIGGMSHLEMGHTMVIPMSGDNFKGVCPYHQNRCFEGMASGPAIEARTGKPGEQLKRTNEVFKLISYYIAQLVFDAYLNFMPERIVIGGSVVSETELPVIRRDVEQLNNNYVELPNLDHLIVLTGIANNGSATIGNVALAKNLIF

SEQ ID NO: 277 - protein, 852 aa, Lactobacillus plantarum
MLSDQLFSNVLKELETHPEANFTLDGQTSILDEYVEMHPEDVIRIKKLINRNQLFVGPWYTQTDAMIPDAESIIRNLVIGINDTKQKYGQPMMIGYLPDTFGFNSQLPMLLNQVGINDFIFWRGTNFKRQMDSVYFKWHSLGHSQVYAANFPLGYYTGQIALDSKKNLQEFVANRLDPGIDFESQQGQNNSVLVPSGIDQMNIIHNVSETISKINKYSHNQIVISNYPKFMRTLRQRNDLPDYQGELRYPTYARVHRTIGSVRSRIKRQNFKLEQQILRRVEPLMVIAKRCGIDVSKGLILKLWKKLLECQPHDSLGGSVSDNVAIDIDHRFKQGFEIADGIENYIKKRIAQRLKLDANQVLVFNTDPRPFNGYKKIRFLTSSKNIMFDEKYQATILSANYVAKRENIMQQTAKGFEFKDEPGYYELQVQVAVQFDGLGYQVIDFKDGAEALPELQSEQQTAIQNESWKVNYVDGNFQATTNGKTYKNIISIVDSGNDGDTYDYSPLRGDKEVDLPLAGVVAIYVGAGRQELRLSGKWQLPEGLADRISHEPKLHDVAFELTLTLTDGDNVLAGRLTVDNQVLDHRLRLKINTAIESDTAVAQVQGGFQRTRNLPIAENWEEEFVEKPVNLYNFDKIVGMQGASDGLYLIAKGMKEYELGKKAFYVTLMATTGQLGKPNLLWRPGRASGDTTSIGHQMTPTPLAEELGANTFEFGLVSTSQLNENKLAIIAEKWLAPDVSYQLQKLNLFVNRLDNKIWDVEFDDSLPTISECESFLKLDPHVTISALYPAYTVPNSFVIRLANESGVAADLTPLLKQHFIQVNALEEAQPCSEQLVIQPYDMVTLLIHNQGA

SEQ ID NO: 278 - protein, 366 aa, Lactobacillus plantarum
MKKILAEWKGYLMSGISYMLPVVIGGSLVVAVPKLIGLCFGITSFDAYKTGFWFYMGQIEAVGWIGVGLVNLVLAGYIAYAIGDKPALAAGFIGGSLASSSNMGFLGALVAGFAAGYTARWCHNKLHVGEKFESIMPLVVVPLLSTMVVAILMGVILKQPLTWINVSLVAWIKQMSTSGVSAITLAVIMGAMIGSDLGGPVNKAAWMAGNVLLAEKIYTPAMIVNVAIAGIPLGYAFATTFFKHRFSDELLDAGRSDWFMGFIGITEGAIPFTLVNPLKLIPINMIAGAAGSATTILLGAQAKIPPVGGVYGFVTITNGWAYLIGLIVCAAIIGVLAPLAVDFNQTQSEEQVTDDNEDDININFEA

SEQ ID NO: 279 - protein, 106 aa, Lactobacillus plantarum
MDFVAITSCPAGLAHTPMAAKALEKAAQELGLQAKVEQQGAMGLKNEITVEEAKSAKFLLIGSDQKIEKMDRFEGIPAVRVDINMCIKKPKAVIDKVSKAVAARVK

SEQ ID NO: 280 - protein, 153 aa, Lactobacillus plantarum
MTEIFKQKYIFLKEHFRTREDVFSFIAHKAIELGFADNEDAVLKALYQREKEASTGMQDGIAIPHAISEYLRQPAVLFIRSTTSIQDWPTFDDQPVNQVIAMLVPKNSEQAHLQILANFASALVDDRERQALLESQTVQDVYTVLTNSSEKIL

SEQ ID NO: 281 - protein, 634 aa, Lactobacillus plantarum
MAPNSSPATLTRMIIELILSKRIVHYQDIMEYTGTSRKTIAKYLNEVEKVVNQQGVHLVRKRGQGIRFSGNTKGLLAEFPILKDNSQSEQERRISIMTFLTQQSKPVLLDDIADHFFISRSTLERDLNVLKMDYGLKLTATTEGVKFNSSESDVRRVIGQLLQSYWGQEIKQNQQTGKMTRTFKVPQSLKRYVNKQTLNQMQKVLNKFVKILKVDVNEYQYESLLIHTTIAIQRIKNGEFITQTTTQNFDTMAISSSTNKLVKMLIVAFKCEIPDEEVAYLNMHVAAIEDGYIDLDRSGLVERTIVDWLRSVLTDYDNQLLRNLTLHLRPALVRIKNGISITNPYCNQVKTYFPVAFDQALALAMAIEKQYHLQLTEDEIAYLALHFESFIERRKILKPDVELAIVCSTGYGTAELLKQRVMDKLPDVQIVGTLSVNELMTSTVTADIIISTIPLKMSGTRVIQVSPFLNDQELSLLEKLSQDIRQEKYTRNAFVKLLSPNGIITNSKATEKKMAIIQLTDRLEKYGYVDNQMQNSALAREQVASTIIDKFAIPHGDIDHVLQPTIGIMTSKKGIKWDHENVHIVFFVALNRTVETQMDDIYSYFYNLIQDGQRMTALIKAQNAQEIIDTLAQQ

SEQ ID NO: 282 - protein, 65 aa, Lactobacillus plantarum
MKKIKTHDDYRHHKSTTINHFYEKLLKLASSMNTRTGKQEASRRTKYMRDFLSEFQMETGVKDET

SEQ ID NO: 283 - protein, 145 aa, Lactobacillus plantarum
MSGNTKYFISRLTTYFEKERHVRVSSINVKEHPEFTTLDQPFVTFLPAFLKGGNGVNNGYTEILTTILGDYLAYEGNYQHCYGIIGSGNRNFNKQFALTAKQYAKRFDFPYITDFELRGTAHDIPRIADAILTYRNQFCFQTTKE

SEQ ID NO: 284 - protein, 722 aa, Lactobacillus plantarum
MVTSTPEMENTYFYLNNLVNIPSNGEIPLHYDQEALKAYFEETVKPKTKQFDSLNAKLNYLVDEDYIDPSILEQYSHKFVQSLFDQMRDHHFRFRSFLGAYKFYTQYAMKTNDGQQFLEDFVDRVVFNALYLANGDEQLANDIADELISQRYQPATPTFLNAGKKRRGEMVSCFLIDVADSMLSIGRGVNSALQLSRIGGGVGVNLSNLRASGDPIKQISNASSGVVPVMKLLEDSFSYSNQLGQRNGAGVVYLNVFHPDILHFLDTKKENADEKIRVKTLSLGLIVPDKYYELLKTNEPMYLFSPYDVEREYRTPFAYIDITKEYNNMAANPNIKKSVFNARKLEQKISQLQQESGYPYILNIDTANQTNPVDGKIIMSNLCSEILQPQEPSKLDDDLSYKTTGTDISCNLGSTNIMNMIDSPDFGHSVEVAVRALTLVTDTTDVKEVPTVKHGNELYHTIGLGAMGLHTALARHQIEYGSPEALEFTDAYFLALNYYSLVTSNRIARERHETFAKFDQSKYADGSYFDQYLNADFKFKSTKVAKIFKNIKLPSVTDWKALKQAVITGGLYHRNRLAVAPNGSISYVNETSASLHPITQLVEQRQENKVGSIFYPAPYLSNETLPYYTPAYDIDQRKIIDTYAVAQKHIDQGMSLTLFMRSVLKPDLYEWKDNNNLKMTTRDLNRLRNYAWTKGIKSLYYIRTFTEDDEIKTANECESCMI

SEQ ID NO: 285 - protein, 308 aa, Lactobacillus plantarum
MDYLYYKAINWDDIKDNFDKYMWERLTTNFWLDIRIPITNDQTAWQQLSDTQQQAITRMLAGTSMLAVYQSEVGTPAIRHDRRTQQEESVLNTITFMKSVHAKSCTTIFRALIPGNGGESFTWADDNANLQAEIDQLAQMSTSDMALQKKALFILTETGLSFGKYWTILQTQALVNTYQILANILRGSALFSAYIGYKFRLRFEELTVSDQTELQYWINTQFDQLMQTEKDFLEANLDDATEAINLASYGANHALMSLGFNAVYEVQPSSLVAQLKELMIDQNQFLQQVTAANNESDTEKMTDDDYDF

SEQ ID NO: 286 - protein, 316 aa, Lactobacillus plantarum
MSYKTINWDIIEDELDEYVWDKATAQYWLDTRVPVSNDLRDWRTLSGTEKSVINRVVGGLALLDTLQSEEGVDVMRPDVRTRKEAAVLNDFLMMESIHAKSYGTILTSLNDQATVDEVFKWMNNNPRMQYKAKRINDIYQTGNNLEKKVASVFLEGILYYTNFFTPLWYRGNNKLANLSEVIKLVIRDESVHGTYLGYKFQLGYNELSATEQKTFKKWMDELLDDLLENEFAFTEEVYAPIGLAEDVKQFVHYNANKALQNMGFESRFPNAEIKDINPIVMNGISTETANHDFFSQVGAGYLMGNAEAMSSGDYDF

SEQ ID NO: 287 - protein, 209 aa, Lactobacillus plantarum
MTLKQVKRIMSKLGIRCQVRQKKHSRIKQQEQYLQDNVLNQRFSVNQPNQVWLADSTELTYGVNGQYKVRLSGALDLYGRHLIAHKLSETETSKAKVQVFQRAFNFAGDVHPVVHTDRGSACTSGTFNNFLAQHEVTRSMSRPGMPYDNAPMERWWNEFKLRWIDRHAKPVTYKELVALVEEGINYFNQLDCSPARNDLTPAEYWNEAV

SEQ ID NO: 288 - protein, 210 aa, Lactobacillus plantarum
MKIGYARVSSENQNLARQIEALKKSGVEKIFQEKVSGKSVQNRPELQKMLEFIREKDIVTVLDLDRLGRNAQDITDTINLIQQKEATLDVLSLPSFTDIQDVNLRGLLTNLVFEIYKYTAEEERNKIHARQNQGIQLAKERGEYKGRRRQYSPHGSKRYLYKRVVQMLRDGTNIAQIARSTGVQRRQIYRIKEYALKIGDLGTPKREVNS

SEQ ID NO: 289 - protein, 300 aa, Lactobacillus plantarum
MFFKDWTKYNSFELIMITLGCSIYAFSLDLVSIPSGLADGGLSGITLIIRHFFHINLGISTLFLNIPLILIGLRYLGKRMMAYTIYGTICLSLFLIIWSQQPLIQPLPLRNDLLLSSLVAGVLSGLGIGLVFRYNGTTGGSDIIARVGQRSFGFSSGKGILIIDYVVLGLSLSYLDLYHIAYSLIVSFVLSKVIDMVQEGPNRAKVLFIVSDKSQKISQLIDVSLNRGLTYLQAEGGYQHDQKQVIYLVVQPREIPQLKQLIKAIDERAFVTVLDAHEVIGEGFSYQRKRYHVNWQHSKE

SEQ ID NO: 290 - protein, 384 aa, Lactobacillus plantarum
MEFLGTLVIILIATSLFGHLASRVGIPAVIGQLFVGIILGPALLNWVHANDFIHIFSEIGVIILMFIAGLESDLTLLKKYLRPSIIVALLGVLIPMVLIYPVGIVFGLTQFESLFLSVIFAATSVSISVAVMKELNLLDSKSGSTVLGAAVVDDVLAVVLLSIMVSLIGTKAGTDTQIPLALTFLEQLIYFAAIYFVMRFIAPLLARLGTKLLNPVGPTIMAMILCFGMAYIANLIGLSAVIGAFFAGIAIAQTHVAHEVDQSIEPIGYAIFIPVFFVSIGLSMSLAGIEHDLLLIIVLTIVATLTKLLGAGSGAKWAGFSSNEAYLVGAGMVSRGEMALIIAQIGYQSKLISDDYYSAIITAIILTTLLAPLLLKHAARHINY

SEQ ID NO: 291 - protein, 459 aa, Lactobacillus plantarum
MLIGINLGLALIVARLLKREPYIAGSGIPQVEGQLAGELEMHWWSILWRKFIGGILALGPGLFLGREGPSIQLGASVGQGFASGFKLSGTDRRLLIASGAAAGLAAAFNAPIAGTLFVLEEIYHNFSPLVWLTALAGAIGSNFISLNVFGLVPVLHLSYSRSLPVSNYWHLILLGIVLGLFGYLYQRVLLVMPRWYHQLTHLPRPIQGIVPFLLVILVGYFSPNLLGGGNGLIVGFGQYVPPLFVLIAIFIIRFVFSMISYGSGLPGGIFLPILSLGAVIGAVYGVLMNQLGLLSHVYIMNLIIFSMAGYFAGIGKAPFTAILLVTEMVGNLTHLMPLAVISLTAYLVVDLLGGAPIYEALLKQMTMPKTVQQLHRPDHLEIPVFFGSPLNGKMVRDMPWPKEALLIGIRRGEQEVIPHGDTLIHEGDTLVLLTDTTQRPQVKQRIDALLATLEKKHQD

SEQ ID NO: 292 - protein, 295 aa, Lactobacillus plantarum
MQGILFALVPIFAWGSIGLVANKFGGDANQQTLGMTLGAFVFALIVFLFRMPTLTWQIFLIGFIGGLLWAIGQFGQFKSMKYMGVSVASPLSSGSQLVIGGLLGVFAFHEWTKQIQFILGFIAMAVLVVGFYFSAKRDPENAVVKEGRNYTKGLTALTYSTLGYVSYVILFNNLAVLWFNVHFDTLTITLPMSVGMIFGALVMGRFKIKMEKYVYQNMIDGVMFAVGNIFMLMAASAAGDAIAFSFSQLGVIISTIGGILFLGEKKTKKELVYVGIGIVLFVTGAILLAIVKSKG

SEQ ID NO: 293 - protein, 149 aa, Lactobacillus plantarum
MLEKNADLGDYGPAPFAPDLKLAALENENYRTTLWTGDHFQITLMAIPAGGGDIGMEIHHGNDQFIYLVAGIGHVKMGKDKDHLTVDQEIHPGEAVIVPDNTWHNVINAGKQTMKVFSIYSPVKHQKGTNETTKADAIKQEGPLEGTGE

SEQ ID NO: 294 - protein, 250 aa, Lactobacillus plantarum
MNSSVPGQYQITYKYGPDNVSKTITVTVKGGSTSGGGSTNDNNSSTNGSNNNSNGNINSGSDNNSNQTTNPGETTDTNGSTSVTPEIGNGQVAVKGESVYATKKIGLYKKADFKRNNRVKLYSKAKRINRPQFIVKGYQRDNAGKLRYRVQQYNPYTRKYVKGTKGYITASAKYVIPVYYRSTPKSNKITVINRKGLNSYRKTFLTQKVTHYKKGALLKVKKVIKYKLATRYQLTNGHYITANKKFVIQK

SEQ ID NO: 295 - protein, 164 aa, Lactobacillus plantarum
MSSDASHTVEQAIQTLNKAGLPVWSKTTSVGTTYRGRQENVINVVQTLCQLAHKENTETAFELTFSKGCRGDKDADHFANESIKPLTITDLPDFPVQCKYAFYAFGDDDYMNEIQEIVNLAEKVGLEPSEIHYATTLTGNISQLFTYFNQALAYCASTYSTLCY

SEQ ID NO: 296 - protein, 440 aa, Lactobacillus plantarum
MKTIDDIRKLAKDEEVEYIRMTFSDLNGALKNVEIPISLLDEALENKIKIDGSSITGFLPIQNSDMYLHPDLNTWTIYPWITTGGKTAALICDVYNRDGTPFAGDPRFVLKRLNQSLTDIDCGHLNVGAEMEYFLFKADESGKPTDTLNDQASYFDVYPDDNGEACRRETVNTLKQMGFQIEADHHEVAPGQCEIDFRFDDAVFTADRIQLLKLATKAIAVKYGLRATFMPKPKAGMNGSGMHLNTSLFKDGKNLFDDSKGSHGLSSLALNYLAGILAHAQAFTAITNPTINSFKRLVPGFEAPTYVAWAVDNRTALVRVPDGRGPATRFELRSGDPSANPYLAISALLASGLDGIQRQLTPNKNVEDSIYNMTPEQRTDAKIVELPSSLPAALANLKNDDILAKSLGSVVPKYLEIKQDELTNYQMSVTDWEKKTYFNV

SEQ ID NO: 297 - protein, 102 aa, Lactobacillus plantarum
MKNYPSNITRQQFELIRPALENFRKRTKPRKYDLYEVFCAVLYVLKTGCQWRQVPGDFPEWRSAYNYYKIWSTKAEPTADSLLEQVLKKLSLLGELTKDVQL

SEQ ID NO: 298 - protein, 114 aa, Lactobacillus plantarum
MVSQGDIFYVNFNPSRGHEQMNKRPAIALSNDLVCQTSNMTIVAPISSTKRNFPMYHRLTSSQTVYGKVLLDQTIALDLRARHVTDETIVDHVSREELEEIITLYKLLFSIDDK

SEQ ID NO: 299 - protein, 87 aa, Lactobacillus plantarum
MELIKEQTRLAKWGNSKAARIPSQIIKQLKLDDNQDMTITIENGSIVLTPIKKNPTNIHELFKDWQDDGKRDHELDWGKSEGNELQW

SEQ ID NO: 300 - protein, 195 aa, Lactobacillus plantarum
MQQVVLPIKDSNVLKEVQDTLLNNFKAGRRNYTIFQVGKATLLRVSDVMGLKQTDIFNLDGSIKQNAFIHDRKTGKPNTLYLKPVQTELLLYRQWLLDHKLASEWLFPSIQHPDRHITEKQFYKIMSRVGDLLGINYLGTHTMRKTGAYRVYTQSNYNIGLVMHLLNHSSESMTLAYLGLDQASTENMLNQIDFG

SEQ ID NO: 301 - protein, 90 aa, Lactobacillus plantarum
MELLEKQLVEKDKQIEKLQQSLGEAHKLLDQQQQLNLSTNRQNEKLLDAPQKTSEDASKDDTDVLEPTGDHYKGEETKTLKKGLFGWLRR

SEQ ID NO: 302 - protein, 80 aa, Lactobacillus plantarum
MDFTDVYGIKHENCTLITPTEEYRRIIIFMDSVGRRFVAISPNPEPTKYGSAKSHWKQGKPNGAPKEYFHIDKKTANQYG

SEQ ID NO: 303 - protein, 66 aa, Lactobacillus plantarum
MQSGTVKWFNADKGFGFITGSDNKDVFVHFSSIQTDGFKSLDEGQKVSYEVEQGDRGPQATNVVPQ

SEQ ID NO: 304 - protein, 122 aa, Lactobacillus plantarum
MRQDVKKICNLLKQYAKLKRDLTTFNQVSSPSFDGVSSHSSLNGTESRLVNHVDLSYQLKEVEDALNTIDDPQYQFILHDYIIEKRFNRNEACNQLSVSVSKFNYLKNRALEVFKLNYLRTL

SEQ ID NO: 305 - protein, 70 aa, Lactobacillus plantarum
MLGVIKIDEKKVLKPIDEMLADPWQVDIQELFEASVNEPDEIKKNLYDSLYTYILQKRQEDIINRPGFVI

SEQ ID NO: 306 - protein, 67 aa, Lactobacillus plantarum
MKNTIATRRKQRKLSQAELAQLTAVTRQTINAIENNKYDPSLSLAFKLAAILETTVDELFSNGEDVK

SEQ ID NO: 307 - protein, 144 aa, Lactobacillus plantarum
MSRAKRILRFTFWVNNLVFLLLAALIIVSFSHLFYIWAPIISLVLVVTCVAMLWYMRHQLGVKSFKGLYWVDDERDRLITLKVHSTVMVSATYFLYGLLGIICLLLNWRLSSQELGQTLLAIIWLALVASNLQYYWLWIKYDQE

SEQ ID NO: 308 - protein, 195 aa, Lactobacillus plantarum
MQQVVLPIKDSNVLKEVQDTLLNNFKAGRRNYTVFQVGKATLLRVSDVMRLKQADIFNPDGSIKQNAFIHDRKTGKPNTLYLKPVQTELLLYRQWLLDHKLDSEWLFPSIQHPERHITEKQFYKIMSKVGDLLGINYLGTHTMRKTGAYRVYTQSNYNIGLVMHLLNHSSEAMTLAYLGLDQASTESMLDQIDFG

SEQ ID NO: 309 - protein, 92 aa, Lactobacillus plantarum
MTLALTQSDFRANLKKYLDQVNDEDETVYIARSNSRAVAIVSQEKMDWLERALKAKEGSLEYAIARDQLIKRHVLPDDEIVESDDDYWGQFK

SEQ ID NO: 310 - protein, 118 aa, Lactobacillus plantarum
MKKLRFKPRATFNADLKRLASLDKSIIDEVRAAIDLLLEQQQLPSEFEDHELNRRMSGYNEFHLRDTPKNKTPSETNDVLVVYTIDKDELVLIGIRVGSHDRLFPGQNRAKRYRKNDK

SEQ ID NO: 311 - protein, 70 aa, Lactobacillus plantarum
MKLKVWWLSNLIWLIIFSILSFVIFIRKVAGAGTIQTPATKLAAFIVLVVFFIVIILIQLVLLLFVKHRK

SEQ ID NO: 312 - protein, 125 aa, Lactobacillus plantarum
MSKFAIKNHWIEVVLVVLLVGVTILSIGWHIYRYGGDYYYMRVNGSSESFPVTVPVGITQNGYVYRGIAKDKYGNRQRLEVQTVADDLGPFHKGQIIRITYNPKFGVTNYKKVSRDQVPPLARIH

SEQ ID NO: 313 - protein, 391 aa, Lactobacillus plantarum
MNELTTEIIAALAQKQDLDEVFRHHLEIAINQLLQTELAEFLGYERYSYAGINTGNNRNGSYERSFDTKYGQLNLTIPRDRNGRFENHTLPAYGRHSDNLETTVIQLYTKGITTAEIAELIEKMYGAHYSKATVSNMTKAVNEQVQAFQQRRLASQYAAIFLDATYLPLKRDTVQKEAVHIAIGIRPDGTKEVLNYQVAPTESTGIWTELLGTLIKQGVKDVLLFVADGLVGLDEGLNRHFPKAKRQRCLVHVGRNLMNKVRVKDRKAVISDFKQVHRAANREAAELKLNEFANNWHQTYPKLIKDLLKMPNLLTFMDFPPAIRQSLYSTNLIENFNKHLKRTTHHKEQFPTEDSLDRFLVSQFNVYNEKSLKRIHRGFQGLQDTLEASFI

SEQ ID NO: 314 - protein, 579 aa, Lactobacillus plantarum
MCCFNSFSERFVVRIMFKNVRKNKRNIWELFGIIVSFGLITILFSYSLWSTKKYPVIISSDFFFHMNRLKSFLVSVQHQQYFPRIAVTFLNYNGYASPMFYSNLIFYPLIFWAKFSFSYLTLYKILIMITTFSGLVITYVCAWTFTKKQLLAYLIAILYMTSIFYQYELLVRNALGEGVAMIFLPIVLLGMYRLVNASNHGWLCLCLGMTLLVYTHLITTVMCGIMLLFYLIFNVKKVLQNKLILVNLIKASVVSFLLSATFLLPMLEQLKRVPMFINASEIGNINHFIKSPFDLFSGTFANSLESTNLGIIFTLVVGIRIIMCHKQKWLIYGDRFIILGIIIAISSTNVLPWEQLLDYTKLAFLQYPLRLNVFATLLLAIGSGMYIYGELQCYKSKGRRLEIYKILAIVLILFMDFSVIFSITSPTRKSYEKFVNSQTAIDSMQIGNGKEYLPVGTKQQFLSNDVKALRGRTTRVSRKLNEFKIRYQLSKTSNEGKLVVPLLMYPGYAATENKHELKIRQTKNHQICVYPKRSGIIHIWYRGTDVQKYASLVSISTLIILVIFQFFSFIRRQTHLKTT

SEQ ID NO: 315 - protein, 43 aa, Lactobacillus plantarum
MPKTIKELADEFDVSKQAIRKKLDENFREKYVQTVTRNGLYKR

SEQ ID NO: 316 - protein, 311 aa, Lactobacillus plantarum
MSNELVKYDPELNTIPLRRFTPVEMNLFFSVVSRMRDKGDDTVRFTFDQLKELSAYKPTANNRFIDDVQSTYQKILGLRFGSRSKDGLDREMFVMFTRFEIKGSADVPYVDIQIYPKALKLLNNLESWVRYALTEFRDLKSSYAKTTFRILKQFRTTGYAYFSKNDFFELLDIPQSYWSKPANVESRVIRPIKEELTPLFRGLTIRKKYGKGRGKPVIGYSFTWKPERKDANDFSQGKFQDERQKLFNIQNNGELTEQEKWRATDKVKGLPLGSTEKQILAERQIEHDKTIRDQTRQEMLAELQKGFGNNA

SEQ ID NO: 317 - protein, 60 aa, Lactobacillus plantarum
MDEQPEIVQVKVGRTTEAPASGPVKALQIKVDGNKSVIVYNHVNGYILDAVMKAVFPHDH

SEQ ID NO: 318 - protein, 115 aa, Lactobacillus plantarum
MIIDTSKIEQIYLVCGKTDLRKGIDGLAGIVQEQYDLDPYSQALYLFCGTRKDRFKALYWDGDGFLLLYKRLENGHLQWPTNQLAIRRLDPRQLVRLLSGWALDSTVHKVCPPGH

SEQ ID NO: 319 - protein, 308 aa, Lactobacillus plantarum
MAESEKDQIIRKLKAENKGLQEQIAYLRRKLFDHKSEVLNPNQTSLFEKENSVFNEPEQTGDQSSSASNQVRPKKSKKKTRREKVDSKVPVRVTIIKTADGKCPAGHSGIKPIGTRYVREEFHFIPARAYLEKIYEQTYKCEQCAHDTATSGLFKPLVPPALFPHSLASVSLVAEIIHDKFVLGVPLYRQLSGIRRLGYQTSEATLANWVNKSAQQLLPLYEEIHWHLCSAHHLQGDETPIEVLREPGKAATSRSYMWVARTPIKQPNPIVYYAYGTTRSGVFAQSLYEGYLGVLQCDGYSGVQPTWK

SEQ ID NO: 320 - protein, 218 aa, Lactobacillus plantarum
MGIVGYNLLGNSVHRTGCWAHVRRKFYDASQSHIKGADNLLHLIDEMFALEREWQAYSPRVRRRRRRSRLRKVLKRFWRLIDRTEVLPQSRLGKAIVYAQKQRPYLDRIINDGAIDWSNNAAERNMKSLVIGRKNWLFSTSTQGAEATAIWMTFIESAKANHIDPRQYLTDLLKASTILPAFPKSEELEAYLPWNYRRQQNMGQRKDNNEAQATTFAA

SEQ ID NO: 321 - protein, 449 aa, Lactobacillus plantarum
MDKFKNIIIGFGKAGKTLAKYLAQHDETVLLIERSKQMYGGTCINVGCLPSKNLILNGQRGVDFTTAVNKRGEMTRQLRNKNYHMVADEPLATVWDGSARFIDNYVLAVVMSDGTTKKVRGERIFINTGAVPNWPSIPGLEFSQRIFTSKEAMELEKQPKRLAIIGGGYIGLEFAGMFNSFGTHVTIFDQHTRLLEREDPDIATEVVADLTDAGIEIKPATQLTQVKDNGEKVTLYYQQGDQTNTAEFDAVLVAVGRRPNINSLGLENTDIALTSRGAIQVDDHLRTTVQNVWALGDVNGGPMFTYVSLDDFRIIVDQLFDKGDRSTADRMVIPTASFLNPPLASVGLNERQAKSAGYDLQTFKLSVKAIPKARVLEDQRGLYKVIVDQKTHLILGATLYAAEAHEAINLIALAMKAKLPYERLRDMIYTHPTMSEALNDLFKTPVVKS

SEQ ID NO: 322 - protein, 59 aa, Lactobacillus plantarum
MQQQVQQARNPQQKSELKNKLNDIHHEISNRTQKQLQAFTEENSSIKQPKSEFDQSLKR

SEQ ID NO: 323 - protein, 413 aa, Lactobacillus plantarum
MKTNRYVVAFAGVMFHLMIGSVYAWSVFTNPIAKQNGWAESSVALAFSIAIFFLGMSAAFMGKVVEKIGPRLTGTIASFLYGTGTIMTGWAIHQNSIWLLYLSYGVIGGLGLGAGYVTPVSTIIKWFPDKRGLATGLAIMGFGFAAMLTGPVAQQLMASVGLEQTFYLLGTFYFVIMLLAAQFIVRPNLALSSTTENSISQKKGTRLTRGPELTANQALKTKSFTFLWIMFFINITCGIGLVSAASPMAQSMTGMSVQTAAIMVGIIGLFNGFGRLIWATLSDYIGRPATFSAIFILNIVMLSAMLIFKLPLLFVIALCLLMSCYGAGFSVIPAYLGDVFGTKELGAVHGYVLTAWAAAGVVGPLLLSLTHQLFHNYTLTLAAFILIDLLALLISFWIQRDFIKASKLIKSKS

SEQ ID NO: 324 - protein, 58 aa, Lactobacillus plantarum
MKHNKKKLRKLVNKNEIDQLREELTKKNQELYDAKLENEILKKSMTLFGTSKDERKHK

SEQ ID NO: 325 - protein, 755 aa, Lactobacillus plantarum
MTDLFADGTISIHGAQENNLKDVSLDIPKHKTTVFAGLSGSGKSSLVFDTLAAVSRRELNETFPSFTQQYLPKYGQPEVNRIDNLPVAIVVEQKPIGRNSRSTLATYTGIYSVLRLMFSRIGQPWVGYSEWFSFNLPQGMCPKCQGLGFVDDIDERQLIDPNKSLNEGAMTFAGFQPGTWRWKEYGNSGLFDLDKKIKDYTDEEYDLFMHAPQQKLKNPPANWGRTALYEGLVPRMLRSVIHSASGRHHEAALSKIVTRKPCPVCHGTRLNKKALTGKIAGKNIAEVSDMDLVSVLKFLDNISDPKAKTMVRELRSKIQALVDIGLGYLSLGRGTDTLSGGEAQRIKIAKYLTSSLSDLVYVLDEPSVGLHPHDIKLITQSLKKLKEHGNTIILVDHNPAIISTADYVVEMGPQAGKNGGQVTFTGTYDELLRSDTITGKMLREKITFPKPREPQSWLNVNHVTSHNLKDVSTRIPQGVMTVISGPAGSGKSTLVQAFKQQVSDQDYIDLSQDSVGLNIRSTPATYLNILNPLRKLFSKANNGVSTQLFSYNGKGACPRCKGKGVMITEMAFMDPIVQECELCHGKRYSQEALQYTYHGKDISEVLNLSINDTLEFFKDVPDIYKKVSLLHQVGLGYLNLSQSMTTLSGGEVQRVKLAMELNHTGRIYFLDEPTTGLHLQDTQQLIDLFEGLVDKGNTLILIEHNLKLISRADWLVDMGPDAGKFGGQVCFEGHPKDSLNDKNSRTGAALAAIIS

SEQ ID NO: 326 - protein, 201 aa, Lactobacillus plantarum
MAKIGYARVSSKEQHLDRQLAALKDVDKLFTDKLSGANTNRPELQKMLAYIREGDIVMVTELDRLGRNNQDLTKIMNTIQNKGATLDVLNLPSMTGITDPNLRQLMTNLIIELYKYQAESERKRIIERQQQGIALAKQQGKYHGRKAQYNQDDPRLQHAFKLYQAGMSDVDVARNTGIKRTTFIRYRKKFKIVRGGVHEAT

SEQ ID NO: 327 - protein, 107 aa, Lactobacillus plantarum
MIKYTKAAKRAKSHVECDTILIDQDSASDTFPVNDIETSDGTIEHEAHVSKISEAQLYYLKSRGLDEATASQLIIMGFLEPFTKQLPMEYAVELDRLIKFQMEGSIG

SEQ ID NO: 328 - protein, 207 aa, Lactobacillus plantarum
MHLVQAFLLSFTAFFAIMNPFANLPMFVSLTADNSRKEINAIARLAFIVATVIVVLFAFLGNYIFTIFGINLAALRIMGGIILGLIGYHMIQGNVSPIQHDTEKSVKDSVNSSNTNVAISPLAMPILAGPGTIATTMNLASGTNPFIVVAAFVVLAVIAYFIFIYGEQIMDKLGNNIMNVITKLMGLILATIGVKMLIVGVQAAFHL

SEQ ID NO: 329 - protein, 263 aa, Lactobacillus plantarum
MMMNSKNLSLAFKENINSQGMLKIANYLKELGKKSMKYFLTSNPLLAKEQILNPSNEFVNNLQKDIPERANALFICSDPNSYDLTDKFAEEMKTCFFNSGFKFKNFKVLDNRNAKEKSELISEAEVVILAGGHVPTQNIFFQQINLKNELKTANKIIIGFSAGSMNCSEEVYAQPELQGESLDPNYKRFLKGLGITKSQILPHYNLIKNEYLDGKRLFEEITYPDSFGRSFITLNDGCYLYGDGQYEIVYGESFIISDGTIKK

SEQ ID NO: 330 - protein, 149 aa, Lactobacillus plantarum
MSLKLGWLEQYEPIYLFWSGVILAVLLIIFLLITLFWPRSQSLYLHQKSDGQVTVSKKAIEHFALSALQHEPFIGNPKVSAKLSRKRITLKISGDLLNSVNAKKQTANFLNQLKKDLRICLGISEQKKIKIRLVDFNELDANVQQSRVV

SEQ ID NO: 331 - protein, 61 aa, Lactobacillus plantarum
MTELIKAYFWPLIGGIMGLLLAVLIITFGFFKTLFVLIFMAIGITAGYYIQKTGILTNVFK

SEQ ID NO: 332 - protein, 180 aa, Lactobacillus plantarum
MQNGTPSEKTTTNEKSGVKGNLTFDDKVIQKIIGIALSEVDGLLTVDGGFFSNVAEKLVNTSDVTSGIDVEVGKKQVAVDLDIVAEYGIDISKLYDKIKNVIVREVKNMTELEVIEVNVNVVDVKTKEQYEKDSTSLQDRVSDATDKTKEAVSKGAKKSKETLGDSVDKVTSDNKSSRVN

SEQ ID NO: 333 - protein, 83 aa, Lactobacillus plantarum
MGLIWSLIVGAIIGAIAGAITNRGAAMGWIANIVAGLIGAWIGQGLLGTWGPSLAGMALIPSIIGAIILVLIVSLVVGRTSKK

SEQ ID NO: 334 - protein, 46 aa, Lactobacillus plantarum
MDVLKSVFKFMIASTLIVGGVLIGGTVLAAKKVDGIGDTLQHKLHG

SEQ ID NO: 335 - protein, 65 aa, Lactobacillus plantarum
MAKTRTYMDKYKFTAAENQRFARANFTKLVHTNARFEGVNTTLPQTQTIMDGMSVAGVPVEDVLT

SEQ ID NO: 336 - protein, 65 aa, Lactobacillus plantarum
MIKPSKEVEKIEQLLADPWAVDIQGIWEQAAHNPDPDKRKLFDALHTYLLDKRQEQIINEKHFVI

SEQ ID NO: 337 - protein, 135 aa, Lactobacillus plantarum
MNHANDFLTDEDSGLPVFLEPEAVQLLSFWCRTPQQMHRFIGIILNAKYRVEKDHQDIGVIIPLDDEELKPLMTKALRRYFNALRSNEKHIKNVENYLYGTMQNLFGIWWNKKAVRKYAAKHPEEQNTDNERSWN

SEQ ID NO: 338 - protein, 198 aa, Lactobacillus plantarum
MTKSTNFNYYEADNVYGALFFQFPKVLMYGEQYKHLSSDAKLAYMVLKDRLEYSLRNHWVDEDNHVYFIFTVQELQGLFNCATEKAVKIKKELQTANLLKQIQMGFNPKTKKNEPNRLYLSKLDVKATDVYLRGEYGQETPKSLATSGISKIESNLYKDSKNIDTNGYNIDTQKLDFSTANFSPAENQQKFEKNRKSA

SEQ ID NO: 339 - protein, 82 aa, Lactobacillus plantarum
MSLDSFNHKKDEEMRESYETTLKDNKKDAVAFLKNISRKEVERKRSVTFSITESQLKKMDAAARKNGFKNRSEFLSSIIDAI

SEQ ID NO: 340 - protein, 268 aa, Lactobacillus plantarum
MKIVTFTAIKGGVGKTTLTLNYGDWLAKNGKKVLLIDLDHQCNLTTVFEKTRRNNTIAEAFKEDDNAQKVKIDSVGPNLDLIAGFIDLDVLGSYLENNSNKEMMLFMWFKNNFDSLSLTDYDYILIDTHPDFSTITKNAIAISNYLLSPITPSEHGYNAKFDLETRLEKFRKSLFDYRTGETYVDAKLFFIGNMIRHNTSMSRDLLKHIEGDETVATIIPERELFNKATARHASIFELANHDESILKQNQKFIEHADHLFQELANKTK
